(12) United States Patent
Loomis et al.

(10) Patent No.: US 10,202,435 B2
(45) Date of Patent: Feb. 12, 2019

(54) ANTI-PACAP ANTIBODIES AND USES THEREOF

(71) Applicant: ALDER BIOPHARMACEUTICALS, INC., Bothell, WA (US)

(72) Inventors: Maria-Cristina Loomis, Bothell, WA (US); Leon Garcia-Martinez, Woodinville, WA (US); Benjamin H. Dutzar, Seattle, WA (US); Daniel S. Allison, Lake Forest Park, WA (US); Katherine Lee Hendrix, Bothell, WA (US); Ethan W. Ojala, Snohomish, WA (US); Pei Fan, Bothell, WA (US); Jeffrey T. L. Smith, Dublin (IE); John A. Latham, Seattle, WA (US); Charlie Karasek, Seattle, WA (US); Jenny Mulligan, Lake Forest Park, WA (US); Michelle Scalley-Kim, Seattle, WA (US); Erica Stewart, Seattle, WA (US); Vanessa Lisbeth Rubin, Seattle, WA (US); Jens J. Billgren, Seattle, WA (US)

(73) Assignee: ALDER BIOPHARMACEUTICALS, INC., Bothell, WA (US)

( * ) Notice: Subject to any disclaimer, the term of this patent is extended or adjusted under 35 U.S.C. 154(b) by 0 days.

(21) Appl. No.: 15/487,607

(22) Filed: Apr. 14, 2017

(65) Prior Publication Data
US 2017/0298127 A1    Oct. 19, 2017

Related U.S. Application Data

(60) Provisional application No. 62/408,347, filed on Oct. 14, 2016, provisional application No. 62/366,902, (Continued)

(51) Int. Cl.
*A61K 49/00* (2006.01)
*A61K 39/395* (2006.01)
(Continued)

(52) U.S. Cl.
CPC ........ *C07K 14/70503* (2013.01); *A61K 38/17* (2013.01); *A61K 38/22* (2013.01); *C07K 14/47* (2013.01); *C07K 14/72* (2013.01); *C07K 16/18* (2013.01); *C07K 16/26* (2013.01); *C07K 16/28* (2013.01); *C07K 16/2869* (2013.01); *C07K 16/4241* (2013.01); *C12N 5/06* (2013.01); *G01N 33/6854* (2013.01); *A61K 38/00* (2013.01); *A61K 48/00* (2013.01); *A61K 2039/505* (2013.01); *C07K 2317/24* (2013.01); *C07K 2317/34* (2013.01); *C07K 2317/56* (2013.01);
(Continued)

(58) Field of Classification Search
CPC ............ C07K 2317/02; C07K 2317/76; C07K 2317/24; C07K 2317/56; C07K 2317/55; C07K 2317/33; C07K 2317/622; C07K 2317/31; C07K 2317/21; C07K 2317/94; C07K 2317/41; C07K 6/00; C07K 2317/54; C07K 2317/734; C07K 16/464
See application file for complete search history.

(56) References Cited

U.S. PATENT DOCUMENTS

| | | |
|---|---|---|
| 5,198,542 A | 3/1993 | Onda et al. |
| 5,486,472 A | 1/1996 | Suzuki et al. |
| (Continued) | | |

FOREIGN PATENT DOCUMENTS

| | | |
|---|---|---|
| EP | 0522159 | 12/2001 |
| EP | 2009026 | 12/2008 |
| (Continued) | | |

OTHER PUBLICATIONS

Amen, F.M. et al., "Headache and prolonged dilation of the middle meningeal artery by PACAP 38 in healthy volunteers", Cephalalgia, 2011; 32(2): 140-149.
Amen, F.M. et al., "Investigation of the pathoshysiological mechanisms of migraine attacks induced by pituitary adenylate cyclase-activating polypeptide-38", Brain, 2014; 137: 779-794.
Baun, M. et al., "Pharmacological characterization and expression of VIP and PACAP receptors in isolated cranial arteries of the rat", European Journal of Pharmacology, 2011; 670: 186-194.
(Continued)

*Primary Examiner* — Chang-Yu Wang
(74) *Attorney, Agent, or Firm* — Robin L. Teskin; LeClairRyan PLLC

(57) ABSTRACT

The present invention is directed to antibodies and antigen binding fragments thereof having binding specificity for PACAP. The antibodies and antigen binding fragments thereof comprise the sequences of the $V_H$, $V_L$, and CDR polypeptides described herein, and the polynucleotides encoding them. Antibodies and antigen binding fragments described herein bind to and/or compete for binding to the same linear or conformational epitope(s) on human PACAP as an anti-PACAP antibody. The invention contemplates conjugates of anti-PACAP antibodies and binding fragments thereof conjugated to one or more functional or detectable moieties. Methods of making said anti-PACAP antibodies and antigen binding fragments thereof are also contemplated. Other embodiments of the invention contemplate using anti-PACAP antibodies, and binding fragments thereof, for the diagnosis, assessment, and treatment of diseases and disorders associated with PACAP and conditions where antagonism of PACAP-related activities, such as vasodilation, photophobia, mast cell degranulation, and/or neuronal activation, would be therapeutically beneficial.

19 Claims, 64 Drawing Sheets
Specification includes a Sequence Listing.

Related U.S. Application Data filed on Jul. 26, 2016, provisional application No. 62/323,495, filed on Apr. 15, 2016, provisional application No. 62/323,573, filed on Apr. 15, 2016, provisional application No. 62/322,939, filed on Apr. 15, 2016, provisional application No. 62/322,957, filed on Apr. 15, 2016.

(51) Int. Cl.

| | |
|---|---|
| A61K 39/00 | (2006.01) |
| A61K 49/16 | (2006.01) |
| C07K 16/00 | (2006.01) |
| G01N 33/53 | (2006.01) |
| C12P 21/08 | (2006.01) |
| C07K 14/705 | (2006.01) |
| A61K 38/17 | (2006.01) |
| A61K 38/22 | (2006.01) |
| C07K 14/47 | (2006.01) |
| C07K 14/72 | (2006.01) |
| C07K 16/18 | (2006.01) |
| C07K 16/28 | (2006.01) |
| C12N 5/07 | (2010.01) |
| C07K 16/26 | (2006.01) |
| C07K 16/42 | (2006.01) |
| G01N 33/68 | (2006.01) |
| A61K 38/00 | (2006.01) |
| A61K 48/00 | (2006.01) |

(52) U.S. Cl.
CPC .... *C07K 2317/565* (2013.01); *C07K 2317/76* (2013.01); *C07K 2317/92* (2013.01); *G01N 2333/575* (2013.01); *Y02A 50/382* (2018.01)

(56) References Cited

U.S. PATENT DOCUMENTS

| | | | |
|---|---|---|---|
| 5,858,787 A | 1/1999 | Onda et al. | |
| 5,892,004 A | 4/1999 | Ohtaki et al. | |
| 5,973,117 A | 10/1999 | Onda et al. | |
| 6,399,316 B1 | 6/2002 | Onda et al. | |
| 7,615,219 B2 | 11/2009 | Freson et al. | |
| 8,728,473 B2* | 5/2014 | Garcia-Martinez | C07K 16/2875 424/130.1 |
| 9,255,154 B2 | 2/2016 | Feldhaus et al. | |
| 9,290,567 B2 | 3/2016 | Bohrmann et al. | |
| 9,365,653 B2 | 6/2016 | Xu | |
| 2002/0155533 A1 | 10/2002 | Onda et al. | |
| 2002/0182729 A1 | 12/2002 | Dicicco-Bloom et al. | |
| 2004/0014095 A1 | 1/2004 | Gerber et al. | |
| 2004/0038888 A1 | 2/2004 | Mercer et al. | |
| 2005/0129687 A1 | 6/2005 | Vizzard et al. | |
| 2006/0062785 A1 | 3/2006 | Freson et al. | |
| 2007/0054843 A1 | 2/2007 | Yeomans et al. | |
| 2007/0149439 A1 | 6/2007 | Dicicco-Bloom et al. | |
| 2007/0202099 A1 | 8/2007 | Inooka et al. | |
| 2010/0112601 A1 | 5/2010 | Shirakawa et al. | |
| 2010/0129372 A1 | 5/2010 | Freson et al. | |
| 2012/0294797 A1 | 11/2012 | Kovacevich et al. | |
| 2012/0294802 A1 | 11/2012 | Russo et al. | |
| 2013/0177568 A1 | 7/2013 | Bhatt et al. | |
| 2013/0267689 A1 | 10/2013 | Latham | |
| 2013/0302399 A1 | 11/2013 | Feldhaus et al. | |
| 2013/0310541 A1 | 11/2013 | Bohrmann et al. | |
| 2014/0370019 A1 | 12/2014 | Bruenker et al. | |
| 2015/0010560 A1 | 1/2015 | Xu | |
| 2016/0304604 A1* | 10/2016 | Loomis | G01N 33/74 |
| 2016/0361441 A1* | 12/2016 | Kuburas | G01N 33/74 |
| 2016/0362488 A1* | 12/2016 | Loomis | G01N 33/74 |
| 2016/0376363 A1* | 12/2016 | Kuburas | G01N 33/74 424/9.2 |
| 2017/0298115 A1* | 10/2017 | Loomis | C07K 16/18 |

FOREIGN PATENT DOCUMENTS

| | | |
|---|---|---|
| WO | WO 91/14786 | 10/1991 |
| WO | WO 1996/039439 | 12/1996 |
| WO | WO 1998/024900 | 6/1998 |
| WO | WO 1999/051762 | 10/1999 |
| WO | WO 2001/023420 | 4/2001 |
| WO | WO 2003/092716 | 11/2003 |
| WO | WO 2004/006839 | 1/2004 |
| WO | WO 2004/062684 | 7/2004 |
| WO | WO 2005/041757 | 5/2005 |
| WO | WO 2005/072385 | 8/2005 |
| WO | WO 2009/000894 | 12/2008 |
| WO | WO 2009/033489 | 3/2009 |
| WO | WO 2010/007175 | 1/2010 |
| WO | WO 2012/010647 | 1/2012 |
| WO | WO 2012/106407 | 8/2012 |
| WO | WO 2016/168757 | 10/2016 |
| WO | WO 2016/168760 | 10/2016 |
| WO | WO 2016/168762 | 10/2016 |
| WO | WO 2016/168768 | 10/2016 |
| WO | WO 2017/106578 | 6/2017 |

OTHER PUBLICATIONS

Bhatt, D.K. et al., "PACAP-38 infusion causes sustained vasodilation of the middle meningeal artery in the rat: Possible involvement of mast cells", Cephalalgia, 2014; 0(0): 1-10.

Boni, L.J. et al., "The in vivo effect of VIP, PACAP-38 and PACAP-27 and mRNA expression of their receptors in rat middle meningeal artery", Cephalalgia, 2009; 29: 837-847.

Botz, B. et al., "Role of pituitary Adenylate-Cyclase Activating Polypeptide and Tac1 gene derived tachykinins in sensory, motor and vascular functions under normal and neuropathic conditions", Peptides, 2013; 43: 105-112.

Chan, K. Y. et al., "Pharmacological characterization , of VIP and PACAP receptors in the human meningeal and coronary artery", Cephalalgia, 2011; 31(2): 181-189.

Chen, D. et al., "Pituitary adenylyl cyclase-activating peptide: A pivotal modulator of glutamatergic regulation of the surachiasmatic circadian clock", PNAS, 1999; 96(23): 13468-13473.

Dickson, L. and Finlayson, K. "VPAC and PAC receptors: From ligands to function", Pharmacology & Therapeutics, 2009; 121: 294-316.

Edvinsson, L., "PACAP and its receptors in migraine pathophysiology: Commentary on Walker et al., Br J Pharmacol 171: 1521-1533", British Journal of Pharmacology, 2015; 172: 4782-4784.

Farnham, M.M.J. and Pilowsky, P.M., "The role of PACAP in central cardiorespiratory regulation", Respiratory Physiology and Neurobiology, 2010; 174: 65-75.

Freson, K. et al., "PACAP and its receptor VPAC1 regulate megakaryocyte maturations therapeutic implications", Blood, Feb. 15, 2008; 111(4): 1885-1893.

Grände, G. et al., "Comparison of responses to vasoactive drugs in human and rat cerebral arteries using myography and pressurized cerebral artery method", Cephalalgia, 2012; 33(3): 152-159.

Harmar, A.J. et al., "Pharmacology and functions of receptors for vasoactive intestinal peptide and pituitary adenylate cyclase-activating polypeptide. IUPHAR Review 1", British Journal of Pharmacology, 2012; 166: 4-17.

Kaiser, E.A. and Russo, A.F., "CGRP and migraine: Could PACAP play a role too?", Neuropeptides, 2013; 47: 451-461.

Khan, S. et al., "Sphenopalatine ganglion neuromodulation in migraine: What is the rationale?", Cephalalgia, 2014; 34(5): 382-391.

Kumar, S. et al., "Crystal Structure of the PAC1R Extracellular Domain Unifies a Consensus Fold for Hormone Recognition by Class B G-Protein Coupled Receptors", PLOS One, 2011; 6(5): 1-11.

Markovics, A. et al., "Pituitary adenylate cyclase-activating polypeptide plays a key role in nitroglycerol-induced trigeminovascular activation in mice", Neurobiology of Disease, 2012; 45: 633-644.

Moody, T.W. et al., "VIP and PACAP. Recent insights into their functions/roles in physiology and disease from molecular and genetic studies", Curr Opin Endocrinol Diabetes Obes., Feb. 2011; 18(1): 61-67.

(56) References Cited

OTHER PUBLICATIONS

Nassini, R. et al., "The 'headache tree' via umbellulone and TRPA1 activates the trigeminovascular system", Brain, 2012; 135: 376-390.
Ng, S.Y.L. et al., "Agnathan VIP, PACAP and Their Recrptors: Ancestral Origins of Today's Highly Diversified Forms", PLOS ONE, Sep. 2012; 7(9): 1-15.
Noseda, R. et al., "A neural mechanism for exacerbation of headache by light", Nature Neuroscience, Feb. 2010; 13(2): 239-246.
Rudikoff, S. et al., "Single amino acid substitution altering antigen-binding specificity", PNAS, 1982; 79: 1979-1983.
Schmidt-Choudhury, A. et al., "Mast cells contribute to PACAP-induced dermal oedema in mice", Regulatory Peptides, 1999; 82: 65-69.
Schwarzhoff, R. et al., "Specific monoclonal antibodies neutralize the action of PACAP 1-27 or PACAP 1-38 on intestinal muscle strips in vitro", Regulatory Peptides, 1995; 55: 57-66.
Schytz, H.W. et al., "Cutaneous nociception and neurogenic inflammation evoked by PACAP38 and VIP", J Headache Pain, 2010; 11: 309-316.
Schytz, H.W. et al., "PACAP38 induces migraine-like attacks in patients with migraine without aura", Brain, 2009; 132: 16-25.
Schytz, H.W. et al., "The PACAP Receptor: A Novel Target for Migraine Treatment", Neurotherapeutics, 2010; 7(2): 191-196.
Schytz, H.W. et al., "What have we learnt from triggering migraine?", Curr Opin Neruol, 2010; 23: 259-265.
Sun, C. et al., "Solution structure and mutational analysis of pituitary adenylate cyclase-activating polypeptide binding to the extracellular domain of PAC1-Rs", PNAS, 2007; 104(19): 7875-7880.
Suzuki, N. et al., "Production of Immunoreactive Pituitary Adenylate Cyclase Activating Polypeptide (PACAP) by Human Neuroblastoma Cells, IMR-32: Detection and Characterization with Monoclonal and Polyclonal Antibodies against Different Epitopes of PACAP", J. Biochem., 1993; 113: 549-556.
Syed, A. et al., "Pituitary Adenylate Cyclase-Activating Polypeptide (PACAP) Potentially Dilates Middle Meningeal Arteries: Implications for Migraine", J. Mol. Neurosci., 2012; 48: 574-583.
Tuka, B. et al., "Alterations in PACAP-38-like immunoreactivity in the plasma during ictal and interictal periods of migraine patients", Cephalalgia, 2013; 0(0): 1-11.
Tuka, B. et al., "Peripheral and central alterations of pituitary adenylate cyclase activating polypeptide-like immunoreactivity in the rat in response to activation of the trigeminovascular system", Peptides, 2012; 33: 307-316.
Vécsei, L. et al., "Role of PACAP in migraine headaches", Brain (Scientific Commentaries) 2014; 137: 650-651.
Wang, Z.-Y. et al., "Distribution and effects of pituitary adenylate cyclase-activating peptide in the rabbit eye", Neuroscience, 1995; 69(1): 297-308.
Warren, J.B. et al., "Pituitary Adenylate Cyclase Activating Polypeptide is a Potent Vasodilator in Humans", Journal of Cardiovascular Pharmacology, 1992; 20(1): 83-87.
Yada, T. et al., "Pituitary adenylate cyclase-activating polypeptide (PACAP) is an islet substance serving as an intra-islet amplifier of glucose-induced insulin secretion in rats", Journal of Physiology, 1997; 505.2: 319-328.
Zagami, A.S. et al., "Pituitary adenylate cyclase activating polypeptide and migraine", Annals of Clinical and Translational Neurology, 2014; 1(12): 1036-1040.
Zhang, Y. et al., "Capsaicin-evoked release of pituitary adenylate cyclase activating peptide (PACAP) and calcitonin gene-related peptide (CGRP) from rat spinal cord in vivo", Regulatory Peptides, 1997; 69: 83-87.

* cited by examiner

Figure 1A
Antibody Variable Heavy Chain Protein Features
Sequence
Name     FR1                              CDR1    FR2               CDR2
Ab10     QSVEESGGRLVTPGTPLTLTCTVSGIDLN    SYYMT   WVRQAPGKGLEWIG    FIDAGGDAYYASWAKG
Ab10.H   EVQLVESGGGLVQPGGSLRLSCAASGIDLN   SYYMT   WVRQAPGKGLEWIG    FIDAGGDAYYASWAKG
Ab20     QSVEESGGRLVTPGTPLTLTCTVSGIDLS    SYYMS   WVRQAPGKGLEWIG    FIDTDGSAYYATWAKG
Ab21     QSVEESGGRLVTPGTPLTLTCTVSGIDLS    SYYMT   WVRQAPGKGLEWVG    FIDAGGSAYYATWAKG
Ab21.H   EVQLVESGGGLVQPGGSLRLSCAASGIDLS   SYYMT   WVRQAPGKGLEWIG    FIDAGGSAYYATWAKG
Ab22     QEQLVESGGGLVQPEGSLTLTCTASGFDFS   SNAMC   WVRQAPGKGLEWIG    SIYNADGKNYYAIWAKG
Ab23     QSVEESGGRLVTPGTPLTLTCTVSGFSLN    NYAMS   WVRQAPGKGLEWIG    IMGVNDITYYASWAKG Figure 1B
Antibody Variable Heavy Chain Protein Features
Sequence
Name     FR3                              CDR3           FR4
Ab10     RFTISKTSTTVDLKITSPTTEDTATYFCAR   DLDL           WGQGTLVTVSS (SEQ ID NO: 402)
Ab10.H   RFTISRDNSKNTVYLQMNSLRAEDTAVYFCAR DLDL           WGQGTLVTVSS (SEQ ID NO: 962)
Ab20     RFTISKTSTTVDLKITSPTTEDTATYFCAR   DLDL           WGPGTLVTVSS (SEQ ID NO: 442)
Ab21     RFTISKASTTVDLKITSPTTEDTATYFCAR   DLDL           WGPGTLVTVSS (SEQ ID NO: 842)
Ab21.H   RFTISRDNSKNTVYLQMNSLRAEDTAVYFCAR DLDL           WGQGTLVTVSS (SEQ ID NO: 1202)
Ab22     RFTISRTSSTTVTLQMTSLTAADTATYFCAR  DFDL           WGQGTLVTVSS (SEQ ID NO: 882)
Ab23     RFTISKTSTTVDLKMTSLTTEDTATYFCTR   EIRDDGDSSDKL   WGPGTLVTVSS (SEQ ID NO: 922)

Figure 2A
Antibody Variable Light Chain Protein Features

| Sequence Name | FR1 | CDR1 | FR2 | CDR2 |
|---|---|---|---|---|
| Ab10    | AAVLTQTPSPVSAAVGGTVTINC | QSSESVYGNYLA    | WFQQKPGQPPKLLIY | EASKLES |
| Ab10.H  | DAQLTQSPSTLSASVGDRVTITC | QSSESVYGNYLA    | WFQQKPGKAPKFLIY | EASKLES |
| Ab20    | AAVLTQTPSPVSAAVGGTVSISC | QSSESVYSNYLA    | WFQQKPGQPPKFLIY | EASKLAS |
| Ab21    | AAVLTQTPSPVSAAVGGTVSISC | KSSESVYGDYLA    | WFQQKPGQPPKQLIY | DASTLAS |
| Ab21.H  | DAQLTQSPSTLSASVGDRVTITC | KSSESVYGDYLA    | WFQQKPGKAPKQLIY | DASTLAS |
| Ab22    | AAVLTQTPSPVSAAVGGTVTINC | QSSQSVYDNDWLA   | WFQQKPGQPPKLLIY | LTSTLAS |
| Ab23    | AIKMTQTPSSVSAAVGGTVTINC | QASEDIYTNLA     | WYQQKPGQPPNLLIY | DASDLAS |

Figure 2B
Antibody Variable Light Chain Protein Features

| Sequence Name | FR3 | CDR3 | FR4 | |
|---|---|---|---|---|
| Ab10    | GVPSRFSGSGSGTQFTLTISDLQCDDAATYYC | AGGDISEGVA       | FGGGTEVVVKR | (SEQ ID NO: 422) |
| Ab10.H  | GVPSRFSGSGSGTEFTLTISSLQPDDFATYYC | AGGDISEGVA       | FGGGTKVEIKR | (SEQ ID NO: 982) |
| Ab20    | GVPSRFKGSGSGTQFTLTISDVQCDDAGTYYC | AGGYSSEGVA       | FGGGTEVVVKR | (SEQ ID NO: 462) |
| Ab21    | GVPSRFKGSGSGTQFTLTISGVQCDDAATYYC | AGGYVSAGVA       | FGGGTEVVVKR | (SEQ ID NO: 862) |
| Ab21.H  | GVPSRFSGSGSGTEFTLTISSLQPDDFATYYC | AGGYVSAGVA       | FGGGTKVEIKR | (SEQ ID NO: 1222) |
| Ab22    | GVPSRFSGSGSGTQFTLTISGVQCDDAATYYC | LGGYDEDGDTHV     | FGGGTEVVVKR | (SEQ ID NO: 902) |
| Ab23    | GVPSRFSGSGDGTQFTLTISAVQCEDAATYYC | QGVAWSSNTGYGSA   | FGGGTEVVVKR | (SEQ ID NO: 942) |

Figure 3A
Antibody Variable Heavy Chain DNA Features
Sequence
Name      FR1
Ab10      cagtcggtggaggagtccggggggtcgcctggtcacgcctgggacacccctgacactcacctgcacagtctctggaa
Ab10.H    gaggtgcagcttgtggagtctggggggaggcttggtccagcctgggggggtccctgagactctcctgtgcagcctctg
Ab20      cagtcggtggaggagtccggggggtcgcctggtcacgcctgggacacccctgacactcacctgcacagtctctggaa
Ab21      cagtcggtggaggagtccggggggtcgcctggtcacgcctgggacacccctgacactcacctgcacagtctctggaa
Ab21.H    gaggtgcagcttgtggagtctggggggaggcttggtccagcctgggggggtccctgagactctcctgtgcagcctctg
Ab22      caggagcagctggtggagtccggggggaggcctggtccagcctgagggatccctgacactcacctgcacagcctctg
Ab23      cagtcggtggaggagtccggggggtcgcctggtcacgcctgggacacccctgacactcacctgcaccgtctctggat Figure 3B
Antibody Variable Heavy Chain DNA Features
Sequence
Name      FR1                CDR1                 FR2
Ab10      tcgacctcaat        agctactacatgacc      tgggtccgccaggctccagggaaggggctggaatggatcgga
Ab10.H    gaatcgacctcaat     agctactacatgacc      tgggtccgtcaggctccagggaaggggctggagtggatcgga
Ab20      tcgacctcagt        agctactacatgagc      tgggtccgccaggctccagggaaggggctggaatggatcgga
Ab21      tcgacctcagt        agctactacatgacc      tgggtccgccaggctccagggaaggggctggaatgggtcgga
Ab21.H    gaatcgacctcagt     agctactacatgacc      tgggtccgtcaggctccagggaaggggctggagtggatcgga
Ab22      gattcgacttcagt     agcaatgcaatgtgc      tgggtccgccaggctccagggaaggggcctggagtggatcgga
Ab23      tctccctcaat        aactatgcaatgagc      tgggtccgccaggctccagggaaggggctggaatggatcgga Figure 3C
Antibody Variable Heavy Chain DNA Features
Sequence
Name      CDR2                                                         FR3
Ab10      ttcattgatgctggtggtgacgcatactacgcgagctgggcgaaaggc              cgattcaccatctccaaaacctcga
Ab10.H    ttcattgatgctggtggtgacgcatactacgcgagctgggcgaaaggc              cgattcaccatctccagagacaatt
Ab20      ttcattgatactgatggtagcgcatactacgcgacctgggcgaaaggc              cgattcaccatctccaaaacctcga
Ab21      ttcattgatgctggtggtagcgcatactacgcgacctgggcgaaaggc              cgattcaccatctccaaagcctcga
Ab21.H    ttcattgatgctggtggtagcgcatactacgcgacctgggcgaaaggc              cgattcaccatctccagagacaatt
Ab22      tccatttataatgctgatggtaagaattattacgcgatttgggcgaaaggc           cgattcaccatctccagaacctcgt
Ab23      atcatgggtgttaatgatatcacatactacgcgagctgggcgaaaggc              cgattcaccatctccaaaacctcga Figure 3D
Antibody Variable Heavy Chain DNA Features
Sequence
Name      FR3
Ab10      ccacggtggatctgaaaatcaccagtccgacaaccgaggacacggccacctatttctgtgccaga
Ab10.H    ccaagaacaccgtgtatcttcaaatgaacagcctgagagctgaggacactgctgtgtatttctgtgctaga
Ab20      ccacggtggatctgaaaatcaccagtccgacaaccgaggacacggccacctatttctgtgccaga
Ab21      ccacggtggatctgaaaatcaccagtccgacaaccgaggacacggccacctatttctgtgccaga
Ab21.H    ccaagaacaccgtgtatcttcaaatgaacagcctgagagctgaggacactgctgtgtatttctgtgctaga
Ab22      cgaccacggtgactctgcaaatgaccagtctgacagccgcggacacggccacctatttctgtgcgaga
Ab23      ccacggtggatctgaaaatgaccagtctgacaaccgaggacacggccacctatttctgtactaga Figure 3E
Antibody Variable Heavy Chain DNA Features
Sequence
Name      CDR3                                          FR4
Ab10      gatcttgacttg                                  tggggccagggcaccctggtcaccgtctcgagc
Ab10.H    gatcttgacttg                                  tggggccaagggaccctcgtcaccgtctcgagc
Ab20      gatcttgacttg                                  tggggcccgggcaccctcgtcaccgtctcgagc
Ab21      gatcttgacttg                                  tggggcccgggcaccctggtcaccgtctcgagc
Ab21.H    gatcttgacttg                                  tggggccaagggaccctcgtcaccgtctcgagc
Ab22      gactttgacttg                                  tggggccagggcaccctcgtcaccgtctcgagc
Ab23      gagatccgtgatgatggtgatagttctgataagttg          tggggcccgggcaccctcgtcaccgtctcgagc Figure 3F
Antibody Variable Heavy Chain DNA Features
Sequence
Name
Ab10      (SEQ ID NO: 412)
Ab10.H    (SEQ ID NO: 972)
Ab20      (SEQ ID NO: 452)
Ab21      (SEQ ID NO: 852)
Ab21.H    (SEQ ID NO: 1212)
Ab22      (SEQ ID NO: 892)
Ab23      (SEQ ID NO: 932)

Figure 4A
Antibody Variable Light Chain DNA Features
Sequence
Name     FR1
Ab10     gccgccgtgctgacccagactccatctcccgtgtctgcagctgtgggaggcacagtcaccatcaattgc
Ab10.H   gacgcccagctgacccagtctccttccaccctgtctgcatctgtaggagacagagtcaccatcacttgt
Ab20     gccgccgtgctgacccagactccatctcccgtgtctgcagctgtgggaggcacagtcagcatcagttgc
Ab21     gccgccgtgctgacccagactccatctcccgtgtctgcagctgtgggaggcacagtcagcatcagttgc
Ab21.H   gacgcccagctgacccagtctccttccaccctgtctgcatctgtaggagacagagtcaccatcacttgt
Ab22     gcagccgtgctgacccagacaccatcgcccgtgtctgcagctgtgggaggcacagtcaccatcaattgc
Ab23     gccatcaaaatgacccagactccatcctccgtgtctgcagctgtgggaggcacagtcaccatcaattgc Figure 4B
Antibody Variable Light Chain DNA Features
Sequence
Name     CDR1                                    FR2
Ab10     cagtccagtgagagtgtttacggtaactacttagcc     tggtttcagcagaaaccagggcagcctcccaagctcc
Ab10.H   cagtccagtgagagtgtttacggtaactacttagcc     tggtttcagcagaaaccaggaaaagcccctaagttcc
Ab20     cagtccagtgagagtgtttatagtaactacttagcc     tggtttcagcagaaaccagggcagcctcctaagttct
Ab21     aagtccagtgagagcgtttatggtgactacttagcc     tggtttcagcagaaaccagggcagcctcccaagcaac
Ab21.H   aagtccagtgagagcgtttatggtgactacttagcc     tggtttcagcagaaaccaggaaaagcccctaagcaac
Ab22     cagtccagtcagagtgtttatgataacgactggttagcc  tggttccagcagaaaccagggcagcctcccaagctcc
Ab23     caggccagtgaggacatttacaccaatttagcc        tggtatcagcagaaaccagggcagcctcccaacctcc Figure 4C
Antibody Variable Light Chain DNA Features
Sequence
Name     FR2        CDR2                      FR3
Ab10     tgatctac   gaagcatccaaactggaatct     ggggtcccatcgcggttcagcggcagtggatctgggacacagttca
Ab10.H   tgatctat   gaagcatccaaactggaatct     ggagtcccatcaaggttcagcggcagtggatctggaacagaattca
Ab20     tgatctac   gaagcatccaaactggcatct     ggggtcccatcgcggttcaaaggcagtggatctgggacacagttca
Ab21     tgatctat   gatgcatccactctggcatct     ggggtcccatcgcggttcaaaggcagtggatctgggacacagttca
Ab21.H   tgatctat   gatgcatccactctggcatct     ggagtcccatcaaggttcagcggcagtggatctggaacagaattca
Ab22     tgatctat   ctgacatccactctggcatct     ggagtcccatcgcggttcagcggcagtggatctgggacacagttca
Ab23     tgatctat   gatgcatccgatctggcatct     ggggtcccgtcgcggttcagcggcagtggagatgggacacagttca Figure 4D
Antibody Variable Light Chain DNA Features
Sequence
Name    FR3                                                              CDR3
Ab10    ctctcaccatcagcgacttgcagtgtgacgatgctgccacttactactgt                gcaggcggtgatattagtgaaggtg
Ab10.H  ctctcaccatcagcagcctgcagcctgatgattttgcaacttactactgt                gcaggcggtgatattagtgaaggtg
Ab20    ctctcaccatcagcgacgtgcagtgtgacgatgctggcacttactactgt                gcaggcggctatagtagtgaaggtg
Ab21    ctctcaccatcagcggcgtgcagtgtgacgatgctgccacttactactgt                gcaggcggttatgttagtgcaggtg
Ab21.H  ctctcaccatcagcagcctgcagcctgatgattttgcaacttactactgt                gcaggcggttatgttagtgcaggtg
Ab22    ctctcaccatcagtggtgtgcagtgtgacgatgctgccacttactactgt                ctaggcggctatgatgaagatggtg
Ab23    ctctcaccatcagcgccgtgcagtgtgaagatgctgccacttactactgt                caaggtgttgcttggagtagtaata Figure 4E
Antibody Variable Light Chain DNA Features
Sequence
Name    CDR3              FR4
Ab10    ttgct             ttcggcggagggaccgaggtggtggtcaaacgt      (SEQ ID NO: 432)
Ab10.H  ttgct             ttcggcggagggaaccaaggtggaaatcaaacgt     (SEQ ID NO: 992)
Ab20    ttgct             ttcggcggagggaccgaggtggtggtcaaacgt      (SEQ ID NO: 472)
Ab21    ttgct             ttcggcggagggaccgaggtggtggtcaaacgt      (SEQ ID NO: 872)
Ab21.H  ttgct             ttcggcggagggaaccaaggtggaaatcaaacgt     (SEQ ID NO: 1232)
Ab22    atacgcatgtt       ttcggcggagggaccgaggtggtggtcaaacgt      (SEQ ID NO: 912)
Ab23    ctggttatggttccgct ttcggcggagggaccgaggtggtggtcaaacgt      (SEQ ID NO: 952)

Figure 5
Antibody Heavy Chain Protein Features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab10 | 1-109 | 402 | 30-34 | 404 | 49-64 | 406 | 95-98 | 408 |
| Ab10.H | 1-112 | 962 | 31-35 | 964 | 50-65 | 966 | 98-101 | 968 |
| Ab20 | 1-109 | 442 | 30-34 | 444 | 49-64 | 446 | 95-98 | 448 |
| Ab21 | 1-109 | 842 | 30-34 | 844 | 49-64 | 846 | 95-98 | 848 |
| Ab21.H | 1-112 | 1202 | 31-35 | 1204 | 50-65 | 1206 | 98-101 | 1208 |
| Ab22 | 1-112 | 882 | 31-35 | 884 | 50-66 | 886 | 98-101 | 888 |
| Ab23 | 1-117 | 922 | 30-34 | 924 | 49-64 | 926 | 95-106 | 928 |

Figure 6
Antibody Heavy Chain Protein Features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab10 | 1-29 | 403 | 35-48 | 405 | 65-94 | 407 | 99-109 | 409 | 110-439 | 410 |
| Ab10.H | 1-30 | 963 | 36-49 | 965 | 66-97 | 967 | 102-112 | 969 | 113-442 | 970 |
| Ab20 | 1-29 | 443 | 35-48 | 445 | 65-94 | 447 | 99-109 | 449 | 110-439 | 450 |
| Ab21 | 1-29 | 843 | 35-48 | 845 | 65-94 | 847 | 99-109 | 849 | 110-439 | 850 |
| Ab21.H | 1-30 | 1203 | 36-49 | 1205 | 66-97 | 1207 | 102-112 | 1209 | 113-442 | 1210 |
| Ab22 | 1-30 | 883 | 36-49 | 885 | 67-97 | 887 | 102-112 | 889 | 113-442 | 890 |
| Ab23 | 1-29 | 923 | 35-48 | 925 | 65-94 | 927 | 107-117 | 929 | 118-447 | 930 |

Figure 7
Antibody Light Chain Protein Features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab10 | 1-110 | 422 | 24-35 | 424 | 51-57 | 426 | 90-99 | 428 |
| Ab10.H | 1-110 | 982 | 24-35 | 984 | 51-57 | 986 | 90-99 | 988 |
| Ab20 | 1-110 | 462 | 24-35 | 464 | 51-57 | 466 | 90-99 | 468 |
| Ab21 | 1-110 | 862 | 24-35 | 864 | 51-57 | 866 | 90-99 | 868 |
| Ab21.H | 1-110 | 1222 | 24-35 | 1224 | 51-57 | 1226 | 90-99 | 1228 |
| Ab22 | 1-113 | 902 | 24-36 | 904 | 52-58 | 906 | 91-102 | 908 |
| Ab23 | 1-113 | 942 | 24-34 | 944 | 50-56 | 946 | 89-102 | 948 |

Figure 8
Antibody Light Chain Protein Features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab10 | 1-23 | 423 | 36-50 | 425 | 58-89 | 427 | 100-110 | 429 | 111-216 | 430 |
| Ab10.H | 1-23 | 983 | 36-50 | 985 | 58-89 | 987 | 100-110 | 989 | 111-216 | 990 |
| Ab20 | 1-23 | 463 | 36-50 | 465 | 58-89 | 467 | 100-110 | 469 | 111-216 | 470 |
| Ab21 | 1-23 | 863 | 36-50 | 865 | 58-89 | 867 | 100-110 | 869 | 111-216 | 870 |
| Ab21.H | 1-23 | 1223 | 36-50 | 1225 | 58-89 | 1227 | 100-110 | 1229 | 111-216 | 1230 |
| Ab22 | 1-23 | 903 | 37-51 | 905 | 59-90 | 907 | 103-113 | 909 | 114-219 | 910 |
| Ab23 | 1-23 | 943 | 35-49 | 945 | 57-88 | 947 | 103-113 | 949 | 114-219 | 950 |

Figure 9
Antibody Heavy Chain DNA Features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab10 | 1-327 | 412 | 88-102 | 414 | 145-192 | 416 | 283-294 | 418 |
| Ab10.H | 1-336 | 972 | 91-105 | 974 | 148-195 | 976 | 292-303 | 978 |
| Ab20 | 1-327 | 452 | 88-102 | 454 | 145-192 | 456 | 283-294 | 458 |
| Ab21 | 1-327 | 852 | 88-102 | 854 | 145-192 | 856 | 283-294 | 858 |
| Ab21.H | 1-336 | 1212 | 91-105 | 1214 | 148-195 | 1216 | 292-303 | 1218 |
| Ab22 | 1-336 | 892 | 91-105 | 894 | 148-198 | 896 | 292-303 | 898 |
| Ab23 | 1-351 | 932 | 88-102 | 934 | 145-192 | 936 | 283-318 | 938 |

Figure 10
Antibody Heavy Chain DNA Features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab10 | 1-87 | 413 | 103-144 | 415 | 193-282 | 417 | 295-327 | 419 | 328-1317 | 420 |
| Ab10.H | 1-90 | 973 | 106-147 | 975 | 196-291 | 977 | 304-336 | 979 | 337-1326 | 980 |
| Ab20 | 1-87 | 453 | 103-144 | 455 | 193-282 | 457 | 295-327 | 459 | 328-1317 | 460 |
| Ab21 | 1-87 | 853 | 103-144 | 855 | 193-282 | 857 | 295-327 | 859 | 328-1317 | 860 |
| Ab21.H | 1-90 | 1213 | 106-147 | 1215 | 196-291 | 1217 | 304-336 | 1219 | 337-1326 | 1220 |
| Ab22 | 1-90 | 893 | 106-147 | 895 | 199-291 | 897 | 304-336 | 899 | 337-1326 | 900 |
| Ab23 | 1-87 | 933 | 103-144 | 935 | 193-282 | 937 | 319-351 | 939 | 352-1341 | 940 |

Figure 11
Antibody Light Chain DNA Features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab10 | 1-330 | 432 | 70-105 | 434 | 151-171 | 436 | 268-297 | 438 |
| Ab10.H | 1-330 | 992 | 70-105 | 994 | 151-171 | 996 | 268-297 | 998 |
| Ab20 | 1-330 | 472 | 70-105 | 474 | 151-171 | 476 | 268-297 | 478 |
| Ab21 | 1-330 | 872 | 70-105 | 874 | 151-171 | 876 | 268-297 | 878 |
| Ab21.H | 1-330 | 1232 | 70-105 | 1234 | 151-171 | 1236 | 268-297 | 1238 |
| Ab22 | 1-339 | 912 | 70-108 | 914 | 154-174 | 916 | 271-306 | 918 |
| Ab23 | 1-339 | 952 | 70-102 | 954 | 148-168 | 956 | 265-306 | 958 |

Figure 12
Antibody Light Chain DNA Features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab10 | 1-69 | 433 | 106-150 | 435 | 172-267 | 437 | 298-330 | 439 | 331-648 | 440 |
| Ab10.H | 1-69 | 993 | 106-150 | 995 | 172-267 | 997 | 298-330 | 999 | 331-648 | 1000 |
| Ab20 | 1-69 | 473 | 106-150 | 475 | 172-267 | 477 | 298-330 | 479 | 331-648 | 480 |
| Ab21 | 1-69 | 873 | 106-150 | 875 | 172-267 | 877 | 298-330 | 879 | 331-648 | 880 |
| Ab21.H | 1-69 | 1233 | 106-150 | 1235 | 172-267 | 1237 | 298-330 | 1239 | 331-648 | 1240 |
| Ab22 | 1-69 | 913 | 109-153 | 915 | 175-270 | 917 | 307-339 | 919 | 340-657 | 920 |
| Ab23 | 1-69 | 953 | 103-147 | 955 | 169-264 | 957 | 307-339 | 959 | 340-657 | 960 |

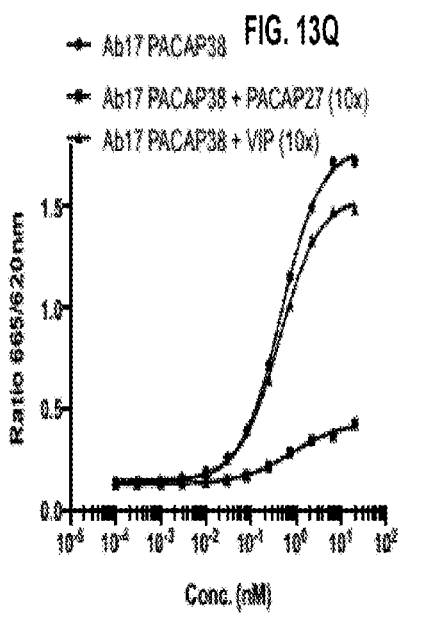
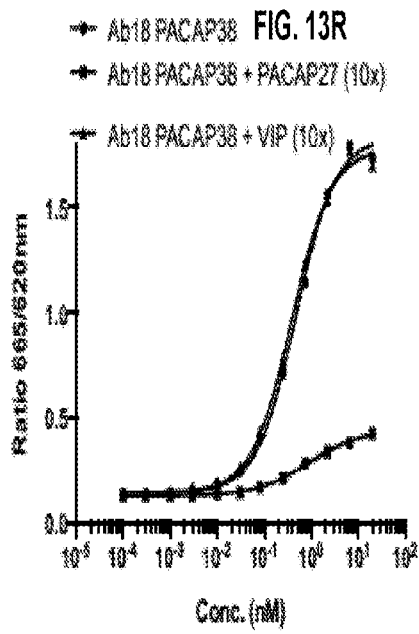
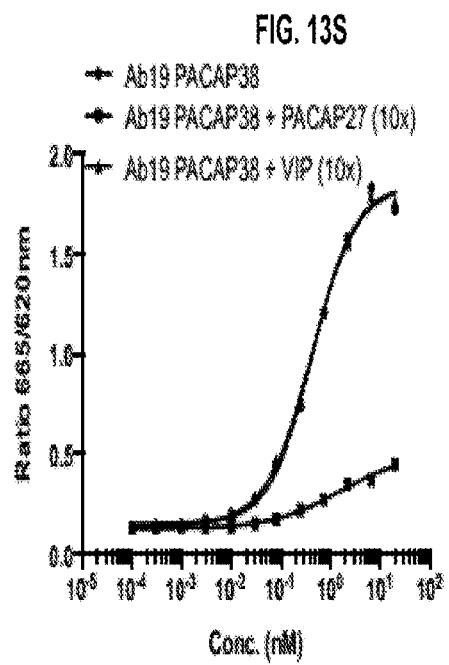
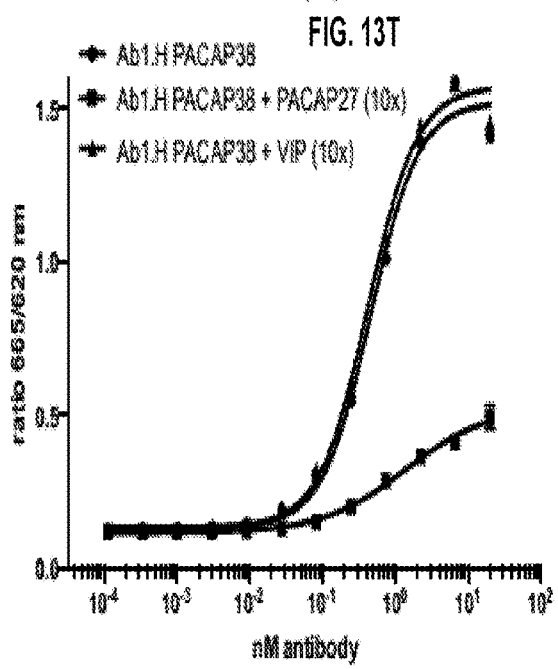

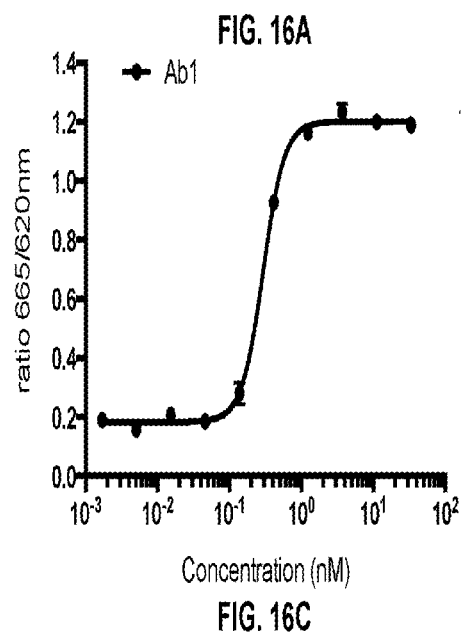
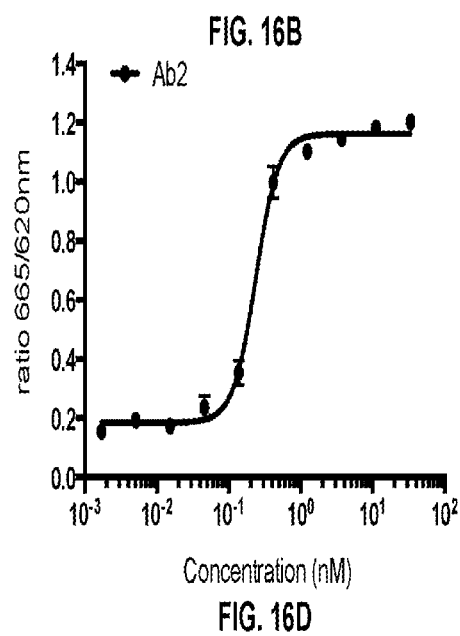
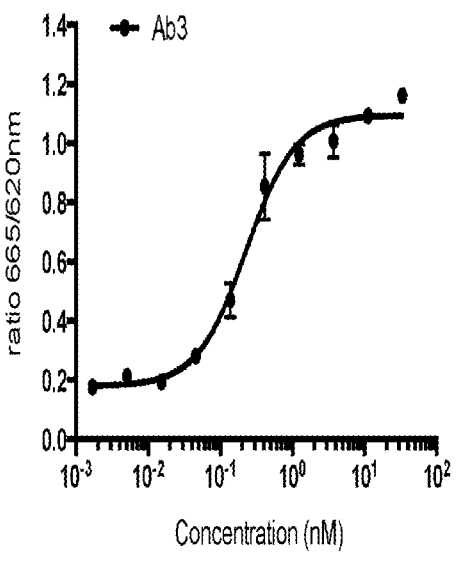
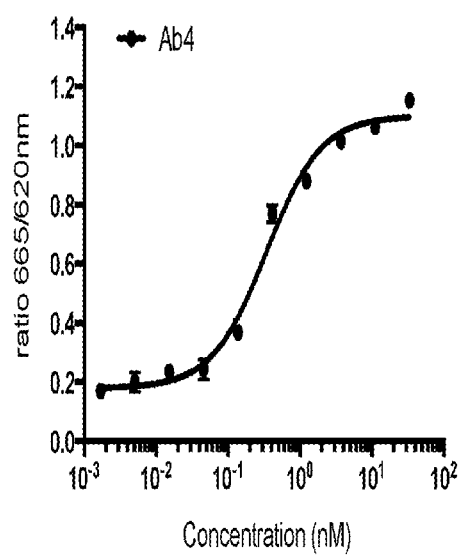

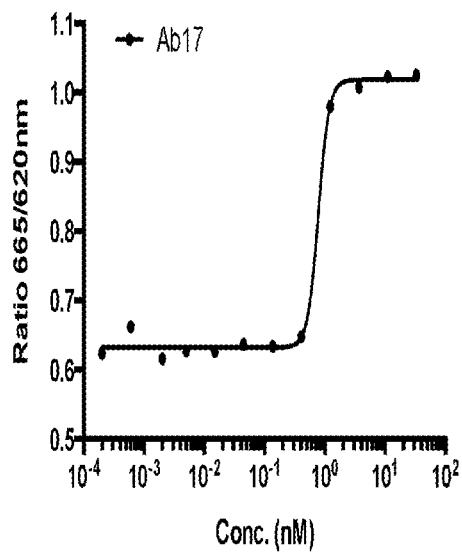
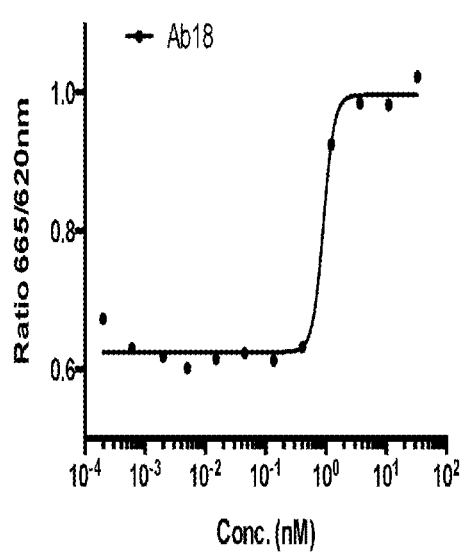
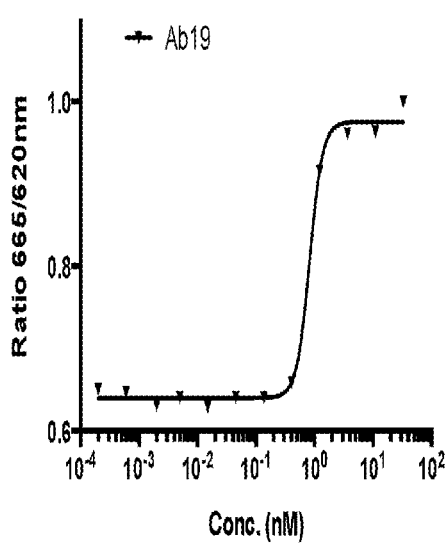
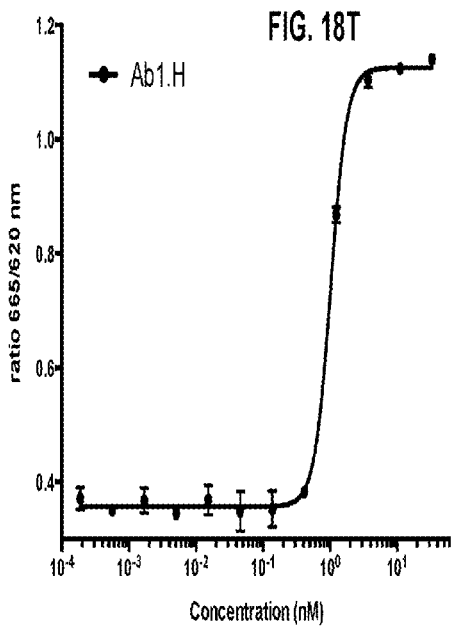

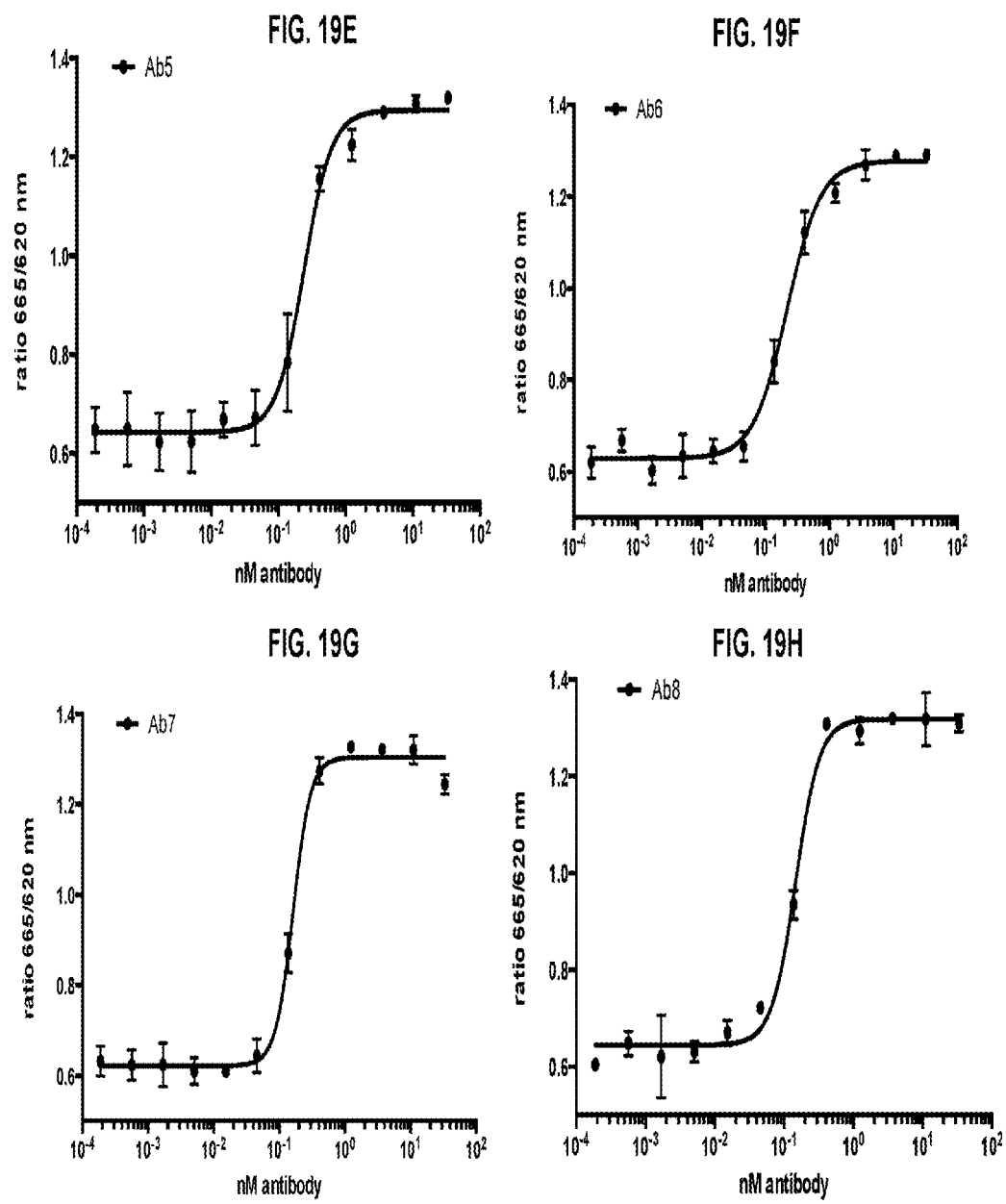

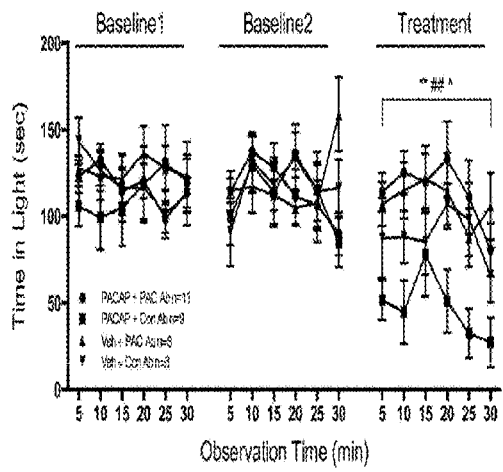
FIG. 23
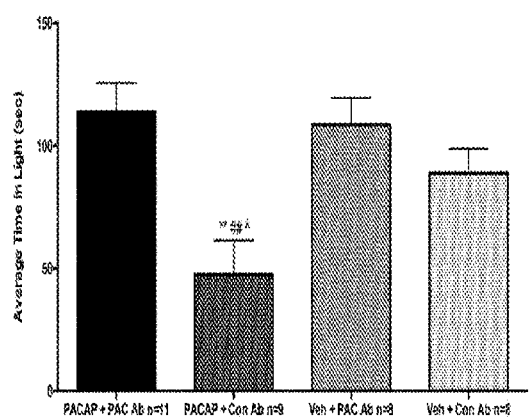
FIG. 24
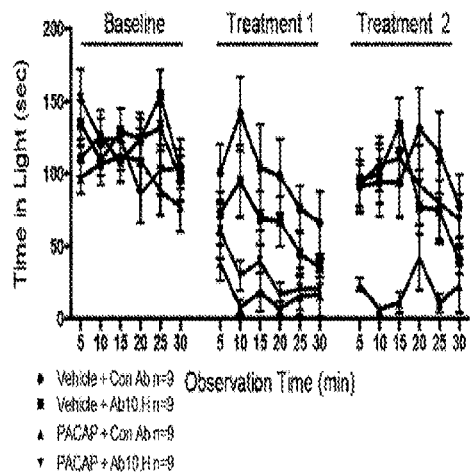
FIG. 25
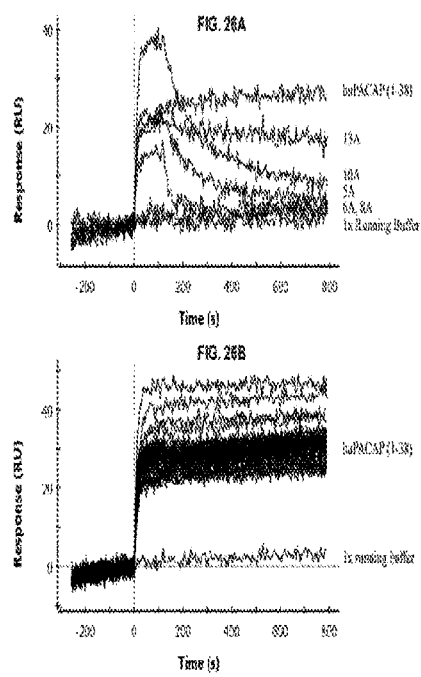
FIG. 26A
FIG. 26B

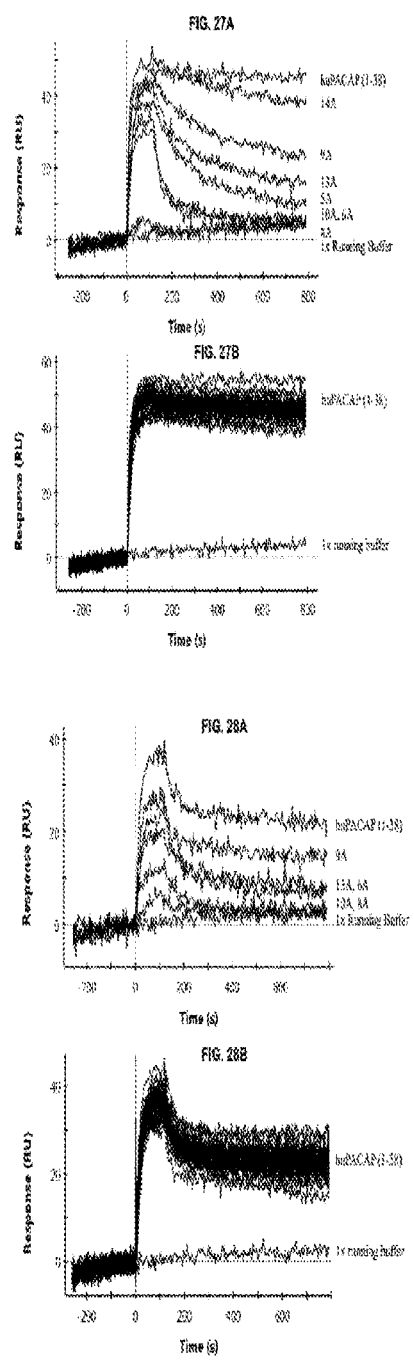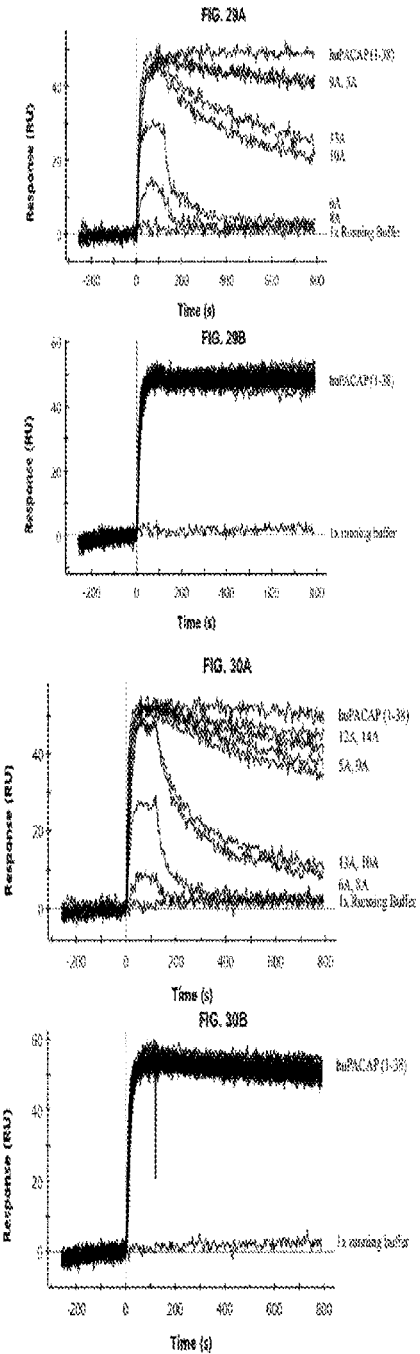

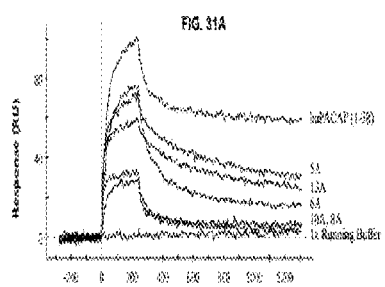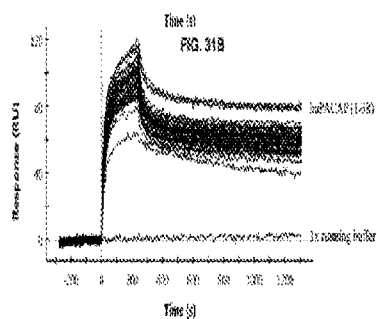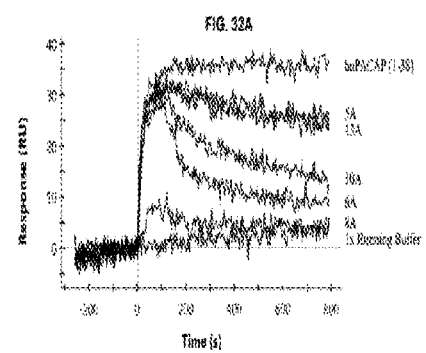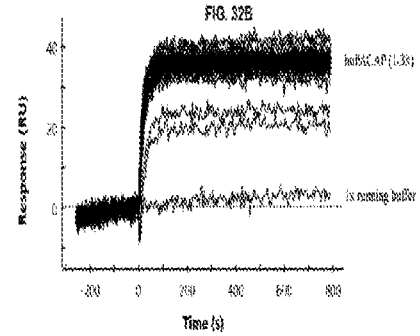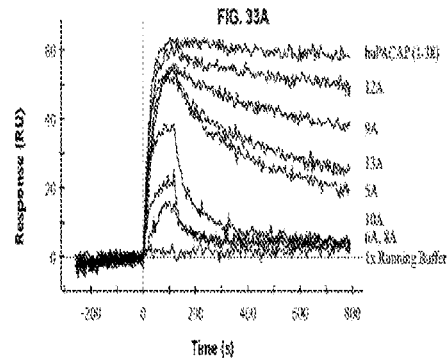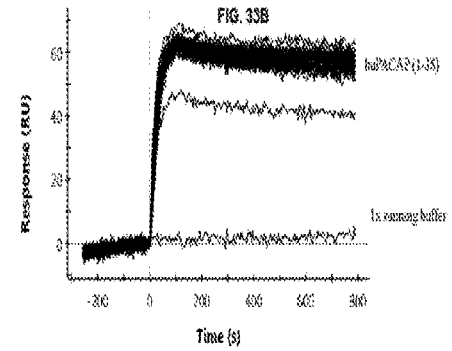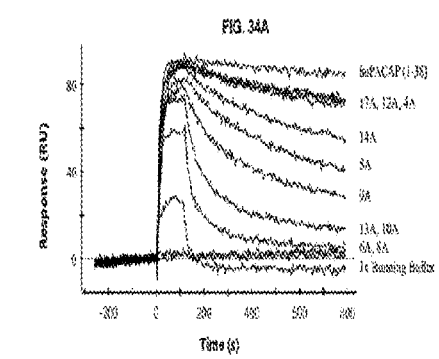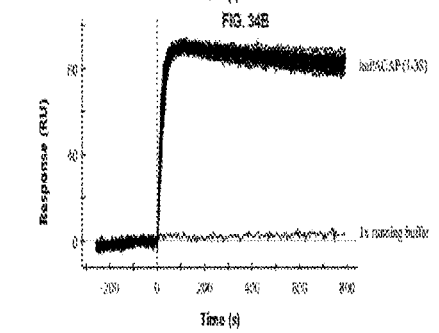

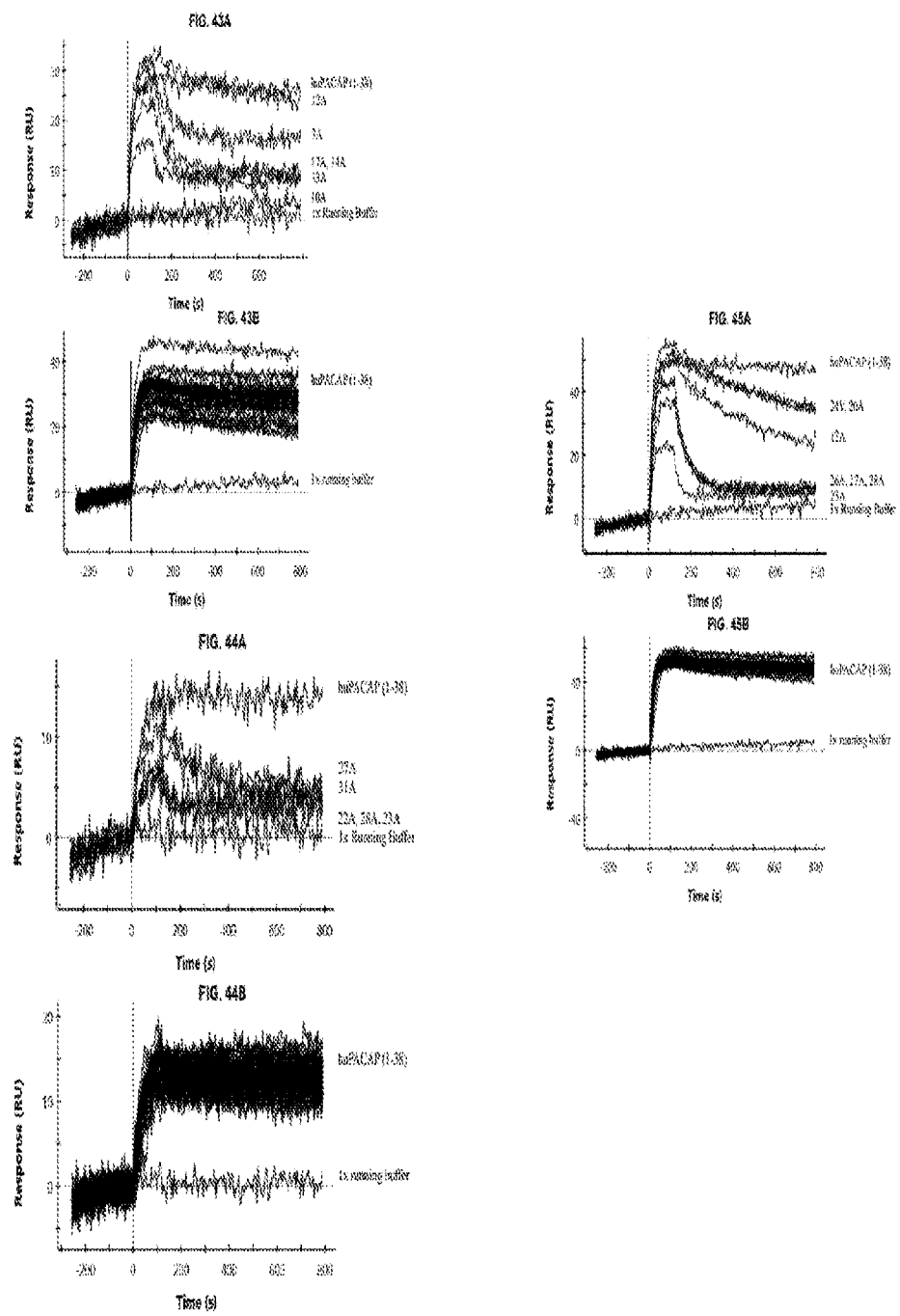

FIG. 46A: Summary of Effects of PACAP Alanine Scanning Mutants on Antibody Binding

| VIP | PACAP | # | Ab1 | Ab2 | Ab13 | Ab14 | Ab15 | Ab16 | Ab17 | Ab18 | Ab19 |
|---|---|---|---|---|---|---|---|---|---|---|---|
| H | H | 1 | | | | | | | | | |
| S | S | 2 | | | | | | | | | |
| D | D | 3 | | | | | | | | | |
| A | G | 4 | | | | | | | | | 4A |
| V | I | 5 | 5A | 5A | | 5A | 5A | 5A | 5A | 5A | 5A |
| F | F | 6 | 6A | 6A | 6A | 6A | 6A | 6A | 6A | 6A | 6A |
| T | T | 7 | | | | | | | | | |
| D | D | 8 | 8A | 8A | 8A | 8A | 8A | 8A | 8A | 8A | 8A |
| N | S | 9 | | 9A | 9A | 9A | 9A | | | 9A | 9A |
| Y | Y | 10 | 10A | 10A | 10A | 10A | 10A | 10A | 10A | 10A | 10A |
| T | S | 11 | | | | | | | | | |
| R | R | 12 | | | | | 12A | | | 12A | 12A |
| L | Y | 13 | 13A | 13A | 13A | 13A | 13A | 13A | 13A | 13A | 13A |
| R | R | 14 | | 14A | | | 14A | | | | 14A |
| K | K | 15 | | | | | | | | | |
| Q | Q | 16 | | | | | | | | | |
| M | M | 17 | | | | | | | | | 17A |
| A | A | 18 | | | | | | | | | |
| V | V | 19 | | | | | | | | | |
| K | K | 20 | | | | | | | | | |
| K | K | 21 | | | | | | | | | |
| Y | Y | 22 | | | | | | | | | |
| L | L | 23 | | | | | | | | | |
| N | A | 24 | | | | | | | | | |
| S | A | 25 | | | | | | | | | |
| I | V | 26 | | | | | | | | | |
| L | L | 27 | | | | | | | | | |

FIG. 46B: Summary of Effects of PACAP Alanine Scanning Mutants on Antibody Binding

| VIP | PACAP | # | Ab1 | Ab2 | Ab13 | Ab14 | Ab15 | Ab16 | Ab17 | Ab18 | Ab19 |
|---|---|---|---|---|---|---|---|---|---|---|---|
| N | G | 28 | | | | | | | | | |
| | K | 29 | | | | | | | | | |
| | R | 30 | | | | | | | | | |
| | Y | 31 | | | | | | | | | |
| | K | 32 | | | | | | | | | |
| | Q | 33 | | | | | | | | | |
| | R | 34 | | | | | | | | | |
| | V | 35 | | | | | | | | | |
| | K | 36 | | | | | | | | | |
| | N | 37 | | | | | | | | | |
| | K | 38 | | | | | | | | | |

FIG. 47A: Summary of Effects of PACAP Alanine Scanning Mutants on Antibody Binding

| VIP | PACAP | # | Ab5 | Ab7 | Ab11 | Ab12 | Ab4 | Ab3 | Ab6 | Ab8 | Ab9 | Ab22 | Ab23 |
|---|---|---|---|---|---|---|---|---|---|---|---|---|---|
| H | H | 1 | | | | | | | | | | | |
| S | S | 2 | | | | | | | | | | | |
| D | D | 3 | 3A | | | | | | | | | | |
| A | G | 4 | 4A | | | | | | | | | | |
| V | I | 5 | 5A | | | | | | 5A | | | | |
| F | F | 6 | 6A | 6A | 6A | 6A | | | 6A | | | | |
| T | T | 7 | 7A | | | | | | | | 7A | 7A | |
| D | D | 8 | | 8A | 8A | 8A | 8A | 8A | | | | | |
| N | S | 9 | | | | | 9A | 9A | 9A | | | | |
| Y | Y | 10 | 10A | 10A | 10A | 10A | 10A | 10A | 10A | 10A | 10A | | |
| T | S | 11 | | 11A | 11A | 11A | | 11A | | | | | |
| R | R | 12 | | | | | 12A | 12A | | 12A | | | 12A |
| L | Y | 13 | 13A | 13A | 13A | 13A | 13A | 13A | 13A | 13A | 13A | | |
| R | R | 14 | 14A | 14A | 14A | 14A | 14A | 14A | 14A | 14A | 14A | | |
| K | K | 15 | | | | | | | | | | | |
| Q | Q | 16 | | | | | | | | | | | |
| M | M | 17 | | | | | 17A | 17A | 17A | | 17A | | |
| A | A | 18 | | 18V | 18V | 18V | 18V | | | | | | |
| V | V | 19 | | | | | | | | | | | |
| K | K | 20 | | | | | | | | | | | 20A |
| K | K | 21 | | | | | | 21A | | | | | |
| Y | Y | 22 | | | 22A | | | | | | | 22A | |
| L | L | 23 | | | | | | | | | | 23A | 23A |
| N | A | 24 | | | | | | | | | | | 24V |
| S | A | 25 | | | | | | | | | | | |
| I | V | 26 | | | | | | | | | | | 26A |
| L | L | 27 | | | | | | | | | | 27A | 27A |

FIG. 47B: Summary of Effects of PACAP Alanine Scanning
Mutants on Antibody Binding

| VIP | PACAP | # | Ab5 | Ab7 | Ab11 | Ab12 | Ab4 | Ab3 | Ab6 | Ab8 | Ab9 | Ab22 | Ab23 |
|---|---|---|---|---|---|---|---|---|---|---|---|---|---|
| N | G | 28 | | | | | | | | | | 28A | 28A |
| | K | 29 | | | | | | | | | | | |
| | R | 30 | | | | | | | | | | | |
| | Y | 31 | | | | | | | | | | 31A | |
| | K | 32 | | | | | | | | | | | |
| | Q | 33 | | | | | | | | | | | |
| | R | 34 | | | | | | | | | | | |
| | V | 35 | | | | | | | | | | | |
| | K | 36 | | | | | | | | | | | |
| | N | 37 | | | | | | | | | | | |
| | K | 38 | | | | | | | | | | | |

ANTI-PACAP ANTIBODIES AND USES THEREOF

CROSS-REFERENCE TO RELATED APPLICATIONS

This application claims the benefit of U.S. Provisional Application Ser. No. 62/322,939, filed Apr. 15, 2016, U.S. Provisional Application Ser. No. 62/322,957, filed Apr. 15, 2016, U.S. Provisional Application Ser. No. 62/323,495, filed Apr. 15, 2016, U.S. Provisional Application Ser. No. 62/323,573, filed Apr. 15, 2016, U.S. Provisional Application Ser. No. 62/366,902, filed Jul. 26, 2016, and U.S. Provisional Application Ser. No. 62/408,347, filed Oct. 14, 2016, each of which is hereby incorporated by reference in its entirety.

SEQUENCE DISCLOSURE

This application includes as part of its disclosure an electronic sequence listing text file named "4325706204.txt", having a size of 639,925 bytes and created on Apr. 14, 2017, which is hereby incorporated in its entirety.

FIELD OF THE INVENTION

This invention generally pertains to antibodies and antigen binding fragments thereof, preferably humanized, chimerized, and human antibodies and antigen binding fragments thereof, and compositions containing such antibodies and antigen binding fragments thereof, wherein such antibodies and antigen binding fragments thereof specifically bind to Pituitary Adenylate Cyclase-Activating Polypeptide ("PACAP") and therapeutic and diagnostic uses for the antibodies, antigen binding fragments, and compositions thereof.

BACKGROUND

Pituitary Adenylate Cyclase-Activating Polypeptide ("PACAP") is a member of the secretin/vasoactive intestinal peptide ("VIP")/growth hormone-releasing hormone ("GHRH") family. PACAP is a multifunctional vasodilatory peptide that exists in two α-amidated active forms, one with 38 amino acids (PACAP38; SEQ ID NO: 1241) and the other with 27 amino acids (PACAP27; SEQ ID NO: 1242). Both peptides have the same N-terminal 27 amino acids and are synthesized from the same precursor protein, prepro-PACAP (See Moody et al., *Curr. Opin. Endocrinol. Diabetes Obes.*, 18(1):61-67 (2011)). PACAP38 is the more prevalent active form, representing up to 90% of PACAP forms in mammalian tissues (See Kaiser & Russo, *Neuropeptides*, 47:451-461 (2013)). The sequence of PACAP38 is identical in all mammals and differs from the avian and amphibian orthologs by only one amino acid (See Vaudry et al., *Pharmacol. Rev.*, 52:269-324 (2000)). The secretin/VIP/GHRH family includes mammalian peptide histidine methioneamide ("PHM"), secretin, glucagon, glucagon-like peptide-1 ("GLP1"), glucagon-like peptide-2 ("GLP2"), glucose-dependent-insulinotrophic-polypeptide ("GIP"), and growth-hormone-releasing-factor ("GRF"). PACAP27 has 68% sequence identity to VIP at the amino acid level (See Vaudry et al. (2000)).

PACAP is widely distributed in the brain and peripheral organs, e.g., the endocrine system, gonads, sympathetic neurons, respiratory system, gastrointestinal tract, cardiovascular system, and urogenital tracts (See Schytz et al., *Neurotherapeutics*, 7:191-196 (2010)). In particular, PACAP is expressed throughout the nervous system, including a presence in the trigeminovascular system, trigeminal ganglia, spinal cord, hypothalamus, and pituitary. PACAP has roles in neurodevelopment, neuroprotection, neuromodulation, neurogenic inflammation, and nociception with multiple actions (See Kaiser & Russo (2013)).

Consistent with its widespread distribution, PACAP exerts pleiotropic effects including modulation of neurotransmitter release, vasodilation, bronchodilation, and activation of intestinal motility, increase of insulin and histamine secretion, as well as stimulation of cell proliferation and/or differentiation. PACAP has been shown to act as a hormone, a neurohormone, a neurotransmitter, and a trophic factor in a number of tissues (Vaudry et al., *Pharmacological Rev.*, 52(2):269-324, 2000).

The biological effects of PACAP are mediated via three different G-protein coupled receptors: PAC1-R, vasoactive intestinal peptide receptor type 1 ("VPAC1-R"), and vasoactive intestinal peptide receptor type 2 ("VPAC2-R"). These receptors are expressed in diverse tissues. PAC1-R is particularly abundant in the nervous system (e.g., olfactory bulb, thalamus, hypothalamus, cerebellum, and spinal dorsal horn), pituitary, and adrenal glands. By contrast, VPAC1-R and VPAC2-R are expressed mainly in the lung, liver, and testis, although they have been detected in other tissues as well. VPAC1-R expression has been detected in the nervous system (e.g., cerebral cortex and hippocampus), smooth muscle cells of lung, liver, intestine, megakaryocytes, and platelets. VPAC1-R associates with receptor-associated membrane protein ("RAMP", specifically RAMP2). (Christopoulos et al., *J. Biol. Chem.*, 278:3293-3297, 2002). VPAC2-R expression profile includes the nervous (e.g., thalamus, hippocampus, brain stem, and dorsal root ganglia ("DRG")), cardiovascular system, gastrointestinal system, pancreas, and reproductive systems. (Usdin et al., *Endocrin.*, 135:2662-2680, 1994; Sheward et al., *Neurosci.*, 67:409-418, 1995).

PAC1-R is selective for PACAP38 and PACAP27. In particular, PAC1-R binds to PACAP with 100-1000-fold greater affinity than VIP, i.e., $K_D$ ~0.5 nM for PACAP27/PACAP38 vs. $K_D$ ~500 nM for VIP. Conversely, VPAC1-R and VPAC2-R have equal affinities for PACAP and VIP ($K_D$ ~1 nM) (See Schytz et al. (2010)).

Upon activation, these receptors are all capable of causing downstream production of cyclic adenosine monophosphate ("cAMP"), and/or activation of phospholipase C ("PLC"), and/or modulation of phospholipase D ("PLD"). In particular, PAC1-R is coupled to dual signal transduction pathways acting through cAMP and $Ca^{2+}$, whereas VPAC1-R and VPAC2-R are coupled principally to adenylyl cyclase. PAC1-R is coupled to $G_s$ protein, which activates adenylyl cyclase to form cAMP that in turn activates protein kinase A. PAC1-R also couples to Gq and thereby activates PLC, which produces inositol phosphate, which increases cytosolic calcium release from intra-cellular calcium stores. There is some evidence for a role of PAC1-R in PLD activation. See McCulloch et al., *Ann. N. Y. Acad. Sci.*, 921:175-185 (2000). Another PACAP signaling pathway results in the elevation of intra-cellular sodium levels via activation of nonselective cation channels. See Roy et al., *American Journal of Physiology: Regulatory, Integrative and Comparative Physiology*, 304(12):R1070-R1084 (2013).

PACAP is hypothesized to play a role in a multitude of diseases and disorders, including but not limited to migraine, headache, and pain, though such a role for PACAP has not been clinically demonstrated. Migraines are believed to have a neurovascular component. Migraines affect approximately 10% of the adult population in the U.S. and are typically accompanied by intense headaches. Approximately 20-30% of migraine sufferers experience aura, comprising focal neurological phenomena that precede and/or accompany the event. A role for PACAP in migraine has been suggested by several observations: (1) plasma levels of PACAP are elevated during migraine attacks (ictal), as compared to interictal levels, in humans (see Tuka et al., *Cephalalgia,* 33(13):1085-1095 (2013)); (2) an infusion of PACAP38 triggered headaches in healthy subjects, and headaches followed by migraine-like attacks in migraineurs (see Schytz et al., *Brain,* 132:16-25 (2009); and Amin et al., *Brain,* 137:779-794 (2014), respectively); (3) PACAP-induced vasodilation may play a role in neurogenic inflammation (see Kaiser & Russo, *Neuropeptides,* 47:451-461 (2013)); and (4) PACAP-induced migraines are associated with photophobia, phonophobia, nausea, and respond to triptans (see Amin et al., *Brain,* 32:140-149 (2012)). PACAP has also been shown to induce vasodilation, photophobia, as well as mast cell degranulation and neuronal activation (See Markovics et al., *Neurobiology of Disease,* 45:633-644 (2012); Baun et al., *Cephalalgia,* 32(4):337-345 (2012); Chan et al., *Pharmacology & Therapeutics,* 129:332-351 (2011)).

One effective treatment for migraines is the administration of triptans, which are a family of tryptamine-based drugs, including sumatriptan and rizatriptan. Members of this family have an affinity for multiple serotonin receptors, including $5\text{-HT}_{1B}$, $5\text{-HT}_{1D}$, and $5\text{-HT}_{1F}$. Members of this family of drugs selectively constrict cerebral vessels, but also cause vasoconstrictive effects on coronary vessels. See Durham, *New Eng. J. Med.,* 350 (11):1073-75 (2004). There is a theoretical risk of coronary spasm in patients with established heart disease following administration, and cardiac events after taking triptans in rare instances may occur. Accordingly, they are contraindicated for some patients with coronary vascular disease.

Similarly, pain may often be addressed through the administration of certain narcotics or non-steroidal anti-inflammatory drugs ("NSAIDs"). However, the administration of these treatments often has negative consequences. NSAIDs have the potential to cause kidney failure, intestinal bleeding, and liver dysfunction. Narcotics have the potential to cause nausea, vomiting, impaired mental functioning, and addiction. Therefore, it is desirable to identify alternative treatments for pain in order to avoid certain of these negative consequences.

PACAP may also be involved in diseases and disorders other than migraine, headache, and pain. For example, PACAP may correlate to or even play a causal role in anxiety disorders (WO 2012/106407); thrombocytopenia (WO 2004/062684); and inflammatory skin diseases (WO 2010/007175). PACAP and PAC1-R polymorphisms are associated with post-traumatic stress syndrome ("PTSD") in females, major depressive disorder, and generalized anxiety disorder, suggesting a role for PACAP in these conditions. Further, supporting a role for PACAP in thrombocytopenia, trisomy 18 patients have excess PACAP and exhibit defective megakaryocyte maturation (See Schytz et al. (2010); and Moody et al., *Curr. Opin. Endocrinol. Diabetes Obes.,* 18(1):61-67 (2011)).

Also, PACAP and other neuropeptides, such as Calcitonin Gene-Related Peptide ("CGRP"), substance P, neurokinin A, bradykinin, and endothelin-1, are expressed in the lower urinary tract ("LUT") (see Arms and Vizzard, *Handbook Exp. Pharmacol.,* 202:395-423 (2011)) and reportedly may play a role in LUT dysfunction and urinary tract disorders such as urinary tract infection ("UTI"), abnormal voiding, urinary urgency, nocturia, urinary incontinence, overactive bladder, and the pain associated with such conditions.

PACAP and PACAP receptors have also been suggested to modulate inflammatory and neuropathic pain and have been implicated in both pronociception and antinociception (See Davis-Taber et al., *J. Pain,* 9(5):449-56 (2008). PACAP has also been reported to be required for spinal desensitization and the induction of neuropathic pain (See Mabuchi et al., *J. Neurosci.,* 24(33):7283-91 (2004)). Additionally, morphine withdrawal behavior is reportedly modified in PACAP-receptor deficient mice further suggesting the role of PACAP in morphine withdrawal anxiolytic response (See Martin et al., *Mol. Brain Res.,* 110(1):109-18 (2003)).

BRIEF SUMMARY OF THE INVENTION

In one aspect, the present invention in general relates to anti-PACAP antibodies and antigen binding fragments thereof, preferably human, humanized, or chimerized anti-PACAP antibodies and antigen binding fragments thereof, that antagonize, inhibit, neutralize, or block at least one biological effect associated with human PACAP. In certain embodiments, the anti-PACAP antibodies and antigen binding fragments thereof inhibit or neutralize at least one biological effect elicited by PACAP, which includes PACAP27 and/or PACAP38, as discussed infra. In other embodiments, the anti-PACAP antibodies and antigen binding fragments thereof neutralize or inhibit PACAP activation of at least one of PAC1-R, VPAC1-R, and/or VPAC2-R; neutralize or inhibit PACAP activation of each of PAC1-R, VPAC1-R, and VPAC2-R; and/or neutralize or inhibit PACAP activation of PAC1-R; and/or inhibits PACAP binding to the cell surface, e.g., via a glycosaminoglycan ("GAG"). In yet other embodiments, the anti-PACAP antibodies and antigen binding fragments thereof are capable of inhibiting PACAP binding to at least one of PAC1-R, VPAC1-R, and/or VPAC2-R; are capable of inhibiting PACAP binding to each of PAC1-R, VPAC1-R, and/or VPAC2-R; or are capable of inhibiting PACAP binding to PAC1-R. In other embodiments, the anti-PACAP antibodies and antigen binding fragments thereof inhibit PACAP-induced cAMP production. In yet other embodiments, the anti-PACAP antibodies and antigen binding fragments thereof, alone or in combination, when administered to a subject, e.g., a human, reduce PACAP-induced vasodilation, photophobia, mast cell degranulation, and/or neuronal activation. In related embodiments, the human or humanized anti-PACAP antibodies and antigen binding fragments thereof are suitable for treating a human subject having an acute, episodic or chronic condition associated with increased vasodilation, photophobia, mast cell degranulation, and/or neuronal activation.

In another embodiment, the method provides a eukaryotic host cell that is mammalian selected from the group consisting of baby hamster kidney ("BHK") cells; chinese hamster ovary ("CHO") cells; mouse sertoli cells ("TM4" cells); African green monkey kidney cells ("VERO-76" cells); human cervical carcinoma ("HELA") cells; canine kidney cells ("MDCK"); buffalo rat liver ("BRL") cells; human lung cells; human liver ("Hep G2") cells; mouse mammary tumor ("MMT") cells; TRI cells; MRC 5 cells; and FS4 cells. Preferably, the mammalian host cell is a CHO cell. More preferably, the mammalian host cell is a CHO K1 cell.

In a preferred embodiment, the anti-PACAP antibodies and antigen binding fragments thereof do not substantially interact with (bind) to VIP. The present invention also encompasses the therapeutic use (as a monotherapy or combination therapy) and diagnostic use of such anti-PACAP antibodies and antigen binding fragments thereof.

More particularly, anti-PACAP antibodies and antigen binding fragments thereof according to the invention can include human, humanized, and chimerized antibodies and fragments thereof, as well as scFvs, camelbodies, shark antibodies, nanobodies, Immunoglobulin New Antigen Receptor ("IgNAR"), fragment antigen binding ("Fab") fragments, Fab' fragments, MetMab like antibodies, bispecific antibodies, monovalent antibody fragments, and F(ab')$_2$ fragments. Additionally, anti-PACAP antibodies and antigen binding fragments thereof according to the invention can substantially or entirely lack N-glycosylation and/or O-glycosylation. In one embodiment, the anti-PACAP antibodies and antigen binding fragments thereof comprise a human constant domain, e.g., that of IgG1, IgG2, IgG3, or IgG4 antibody or a fragment thereof. In another embodiment, the anti-PACAP antibodies and antigen binding fragments thereof may comprise an Fc region that has been modified to alter (enhance or impair) at least one of effector function, half-life, proteolysis, or glycosylation. For example, the Fc region may contain one or more mutations that alters or eliminates N- and/or O-glycosylation.

In some embodiments, anti-PACAP antibodies and antigen binding fragments thereof bind to PACAP with a $K_D$ of less than or equal to $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, or $10^{-13}$ M, e.g., as determined by ELISA, bio-layer interferometry ("BLI"), Kinetic Exclusion Assay (KINEXA®, Sapidyne Instruments, Boise, Id.), or SPR, e.g., at 25° or 37° C. Preferably, the human, humanized, or chimerized anti-PACAP antibodies and antigen binding fragments thereof bind to PACAP with a $K_D$ of less than or equal to $5\times10^{-10}$ M, $10^{-10}$ M, $5\times10^{-11}$ M, $10^{-11}$ M, $5\times10^{-12}$ M, or $10^{-12}$ M. Preferably, the human, humanized, or chimerized anti-PACAP antibodies and antigen binding fragments thereof bind to PACAP with a $K_D$ that is less than about 100 nM, less than about 40 nM, less than about 1 nM, less than about 100 pM, less than about 50 pM, or less than about 25 pM. Alternatively, the anti-PACAP antibodies and antigen binding fragments thereof bind to PACAP with a $K_D$ that is between about 10 pM and about 100 pM. In another embodiment, the human, humanized, or chimerized anti-PACAP antibodies and antigen binding fragments thereof bind to PACAP with an off-rate ($k_{off}$) of less than or equal to $5\times10^{-4}$ s$^{-1}$, $10^{-4}$ s$^{-1}$, $5\times10^{-5}$ s$^{-1}$, or $10^{-5}$ s$^{-1}$.

In yet another embodiment, the anti-PACAP antibodies and antigen binding fragments thereof will specifically bind to the linear or conformational epitope(s) and/or compete for binding to the same linear or conformational epitope(s) on human PACAP as an anti-PACAP antibody selected from the group consisting of Ab1.H, Ab3.H, Ab4.H, Ab5.H, Ab9.H, or Ab12.H (the specific amino acid sequences of the variable and constant regions of these anti-PACAP antibodies, and the nucleic acids that encode for such variable and constant regions, and the epitopes bound thereby as determined using alanine scanning methods are disclosed infra). In particular, the invention embraces anti-PACAP antibodies and antigen binding fragments thereof that specifically bind to the same linear or conformational epitope(s) on human PACAP as an anti-PACAP antibody selected from the group consisting of Ab1.H, Ab3.H, Ab4.H, Ab5.H, Ab9.H, or Ab12.H. As disclosed infra, in exemplary embodiments, the epitope(s) are determined using alanine scanning mutation strategy.

In some embodiments, the present invention provides an anti-PACAP antibodies and antigen binding fragments thereof, are preferably human, humanized, or chimerized anti-PACAP antibodies and antigen binding fragments thereof, comprising at least 2 complementarity determining regions ("CDRs"), or at least 3 CDRs, or at least 4 CDRs, or at least 5 CDRs, or all six CDRs of an anti-PACAP antibody selected from the group consisting of Ab1.H, Ab3.H, Ab4.H, Ab5.H, Ab9.H, or Ab12.H. In instances where all 6 CDRs are not present, preferably at least the $V_H$ CDR3 and $V_L$ CDR3 are present. In exemplary embodiments, the antibodies and antigen binding fragments thereof comprise the heavy chain variable region (VH) and/or the light chain variable region (VL) of one of Ab1.H, Ab3.H, Ab4.H, Ab5.H, Ab9.H, or Ab12.H.

In another specific embodiment, the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1124; a CDR2 sequence consisting of SEQ ID NO: 1126; and a CDR3 sequence consisting of SEQ ID NO: 1128; and/or (b) a light chain variable region comprising a CDR1 sequence consisting of SEQ ID NO: 1144; a CDR2 sequence consisting of SEQ ID NO: 1146; and a CDR3 sequence consisting of SEQ ID NO: 1148. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1122, and/or (b) a light chain variable region comprising an amino acid sequence with at least 80, 85, 90, 95, 96, 97, 98, or 99% sequence identity to SEQ ID NO: 1142. In another embodiment, the anti-PACAP antibodies and antigen binding fragments thereof comprise (a) a heavy chain variable region having the amino acid sequence of SEQ ID NO: 1122, and/or (b) a light chain variable region having the amino acid sequence of SEQ ID NO: 1142. More specifically, the anti-PACAP antibodies and antigen binding fragments thereof can comprise (a) a heavy chain having the amino acid sequence of SEQ ID NO: 1121, and/or (b) a light chain having the amino acid sequence of SEQ ID NO: 1141.

In another specific embodiment, the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1084; a CDR2 sequence consisting of SEQ ID NO: 1086; and a CDR3 sequence consisting of SEQ ID NO: 1088; and/or (b) a light chain variable region comprising a CDR1 sequence consisting of SEQ ID NO: 1104; a CDR2 sequence consisting of SEQ ID NO: 1106; and a CDR3 sequence consisting of SEQ ID NO: 1108. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1082 and/or (b) a light chain variable region comprising an amino acid sequence with at least 80, 85, 90, 95, 96, 97, 98, or 99% sequence identity to SEQ ID NO: 1102. In another embodiment, the anti-PACAP antibodies and antigen binding fragments thereof comprise (a) a heavy chain variable region having the amino acid sequence of SEQ ID NO: 1082, and/or (b) a light chain variable region having the amino acid sequence of SEQ ID NO: 1102. More specifically, the anti-PACAP antibodies and antigen binding fragments thereof can comprise (a) a heavy chain having the amino acid sequence of SEQ ID NO: 1081, and/or (b) a light chain having the amino acid sequence of SEQ ID NO: 1101.

In another specific embodiment, the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1004; a CDR2 sequence consisting of SEQ ID NO: 1006; and a CDR3 sequence consisting of SEQ ID NO: 1008; and/or (b) a light chain variable region comprising a CDR1 sequence consisting of SEQ ID NO: 1024; a CDR2 sequence consisting of SEQ ID NO: 1026; and a CDR3 sequence consisting of SEQ ID NO: 1028. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1002, and/or (b) a light chain variable region comprising an amino acid sequence with at least 80, 85, 90, 95, 96, 97, 98, or 99% sequence identity to SEQ ID NO: 1022. In another embodiment, the anti-PACAP antibodies and antigen binding fragments thereof comprise (a) a heavy chain variable region having the amino acid sequence of SEQ ID NO: 1002, and/or (b) a light chain variable region having the amino acid sequence of SEQ ID NO: 1022. More specifically, the anti-PACAP antibodies and antigen binding fragments thereof can comprise (a) a heavy chain having the amino acid sequence of SEQ ID NO: 1001, and/or (b) a light chain having the amino acid sequence of SEQ ID NO: 1021.

In another specific embodiment, the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1164; a CDR2 sequence consisting of SEQ ID NO: 1166; and a CDR3 sequence consisting of SEQ ID NO: 1168; and/or (b) a light chain variable region comprising a CDR1 sequence consisting of SEQ ID NO: 1184; a CDR2 sequence consisting of SEQ ID NO: 1186; and a CDR3 sequence consisting of SEQ ID NO: 1188. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1162 and/or (b) a light chain variable region comprising an amino acid sequence with at least 80, 85, 90, 95, 96, 97, 98, or 99% sequence identity to SEQ ID NO: 1182. In another embodiment, the anti-PACAP antibodies and antigen binding fragments thereof comprise (a) a heavy chain variable region having the amino acid sequence of SEQ ID NO: 1162, and/or (b) a light chain variable region having the amino acid sequence of SEQ ID NO: 1182. More specifically, the anti-PACAP antibodies and antigen binding fragments thereof can comprise (a) a heavy chain having the amino acid sequence of SEQ ID NO: 1161, and/or (b) a light chain having the amino acid sequence of SEQ ID NO: 1181.

In another specific embodiment, the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1044; a CDR2 sequence consisting of SEQ ID NO: 1046; and a CDR3 sequence consisting of SEQ ID NO: 1048; and/or (b) a light chain variable region comprising a CDR1 sequence consisting of SEQ ID NO: 1064; a CDR2 sequence consisting of SEQ ID NO: 1066; and a CDR3 sequence consisting of SEQ ID NO: 1068. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1042 and/or (b) a light chain variable region comprising an amino acid sequence with at least 80, 85, 90, 95, 96, 97, 98, or 99% sequence identity to SEQ ID NO: 1062. In another embodiment, the anti-PACAP antibodies and antigen binding fragments thereof comprise (a) a heavy chain variable region having the amino acid sequence of SEQ ID NO: 1042, and/or (b) a light chain variable region having the amino acid sequence of SEQ ID NO: 1062. More specifically, the anti-PACAP antibodies and antigen binding fragments thereof can comprise (a) a heavy chain having the amino acid sequence of SEQ ID NO: 1041, and/or (b) a light chain having the amino acid sequence of SEQ ID NO: 1061.

Also, in some embodiments the anti-PACAP antibodies and antigen binding fragments may comprise sequence variants of any of the disclosed antibodies which are modified by mutagenesis, e.g., affinity maturation to alter one or more properties such as binding affinity or immunogenicity.

In another embodiment, the anti-PACAP antibodies and antigen binding fragments thereof are directly or indirectly attached to another moiety, such as a detectable label or therapeutic agent.

In another embodiment, the anti-PACAP antibodies and antigen binding fragments thereof inhibit or neutralize at least one biological effect elicited by PACAP; neutralize or inhibit PACAP activation of at least one of PAC1-R, VPAC1-R, and/or VPAC2-R; neutralize or inhibit PACAP activation of each of PAC1-R, VPAC1-R, and VPAC2-R; neutralize or inhibit PACAP activation of PAC1-R; are capable of inhibiting PACAP binding to at least one of PAC1-R, VPAC1-R, and/or VPAC2-R; are capable of inhibiting PACAP binding to each of PAC1-R, VPAC1-R, and/or VPAC2-R; are capable of inhibiting PACAP binding to PAC1-R; and/or inhibits PACAP binding to the cell surface, e.g., via a GAG; inhibit PACAP-induced cAMP production; and/or when administered to a subject reduce PACAP-induced vasodilation, photophobia, mast cell degranulation, and/or neuronal activation.

In another embodiment, the human, or humanized, anti-PACAP antibodies and antigen binding fragments thereof are suitable for treating a human subject having an acute, episodic, or chronic condition associated with increased vasodilation, photophobia, mast cell degranulation, and/or neuronal activation.

In another embodiment, the anti-PACAP antibodies and antigen binding fragments thereof do not substantially interact with (i.e., bind to) VIP. Preferably, the anti-PACAP antibodies and antigen binding fragments thereof have stronger affinity for PACAP as compared to VIP, i.e., although there is some cross-reactivity, the antibodies preferentially bind to PACAP as compared to VIP. For example, the affinity of said antibodies and antigen binding fragments thereof to PACAP is at least 10-fold, 30-fold, 100-fold, 300-fold, 1000-fold, 3000-fold, 10000-fold, 30000-fold, 100000-fold, 300000-fold, 1000000-fold, 3000000-fold, 10000000-fold, 30000000-fold, or stronger than the affinity of said antibodies and antigen binding fragments thereof to VIP (e.g., the $K_D$ of said antibody or fragment for binding to human PACAP is 10-fold, 30-fold, 100-fold, 300-fold, 1000-fold, 3000-fold, 10000-fold, 30000-fold, 100000-fold, 300000-fold, 1000000-fold, 3000000-fold, 10000000-fold, or 30000000-fold lower than the $K_D$ for binding to VIP).

In one embodiment, the anti-PACAP antibodies and antigen binding fragments thereof are attached to at least one effector moiety, e.g., which comprises a chemical linker. In another embodiment, the anti-PACAP antibodies and antigen binding fragments thereof are attached to one or more detectable moieties, e.g., which comprise a fluorescent dye, enzyme, substrate, bioluminescent material, radioactive material, chemiluminescent moiety, or mixtures thereof.

In one embodiment, the anti-PACAP antibodies and antigen binding fragments thereof are attached to one or more functional moieties.

The invention also contemplates antibodies, e.g., anti-idiotypic antibodies, produced against an anti-PACAP antibodies and antigen binding fragments thereof as described above. Furthermore, the invention provides a method of using the anti-idiotypic antibody to monitor the in vivo levels of said anti-PACAP antibodies and antigen binding fragments thereof in a subject or to neutralize said anti-PACAP antibody in a subject being administered said anti-PACAP antibody or antigen binding fragment thereof.

Moreover, the present invention encompasses a composition suitable for therapeutic, prophylactic, or a diagnostic use comprising a therapeutically, prophylactically, or diagnostically effective amount of at least one anti-PACAP antibody or antigen binding fragment as described herein. In particular, compositions and dosage forms containing the subject anti-PACAP antibodies or binding fragments thereof for use in treating or preventing migraine or other headache indications are provided herein. Also provided herein are dosage forms containing the subject anti-PACAP antibodies or binding fragments thereof for use in treating or preventing photophobia. The composition may be suitable for subcutaneous administration, intra-muscular administration, and/or intravenous administration. The composition may be lyophilized. In some embodiments, the composition further comprises a pharmaceutically acceptable diluent, carrier, solubilizer, emulsifier, preservative, or mixture thereof.

Additionally, in some embodiments, the composition further comprises another active agent, e.g., a chemotherapeutic, an analgesic, an anti-inflammatory, an immunosuppressant, a cytokine, an antiproliferative, and an antiemetic. Preferably, the other therapeutic agent is an analgesic, e.g., an NSAID, an opioid analgesic, an antibody (e.g., an anti-human Nerve Growth Factor ("NGF") antibody or antibody fragment; or an anti-human CGRP or anti-human CGRP-receptor antibody or antibody fragment); or a non-antibody biologic, such as an NGF or CGRP polypeptide fragment or conjugate; or BOTOX® (Botulinum toxin). Suitable NSAIDs for use in combination with the subject anti-PACAP antibodies include, but are not limited to, a cyclooxygenase 1 and/or cyclooxygenase 2 inhibitor; propionic acid derivatives including ibuprofen, naproxen, naprosyn, diclofenac, and ketoprofen; acetic acid derivatives including tolmetin and sulindac; fenamic acid derivatives including mefenamic acid and meclofenamic acid; biphenylcarboxylic acid derivatives including diflunisal and flufenisal; and oxicams including piroxim, sudoxicam, and isoxicam. Suitable opioid analgesics for use in combination with the subject anti-PACAP antibodies include, e.g., codeine, dihydrocodeine, morphine or a morphine derivative or pharmaceutically acceptable salt thereof, diacetylmorphine, hydrocodone, hydromorphone, levorphanol, oxymorphone, alfentanil, buprenorphine, butorphanol, fentanyl, sufentanil, meperidine, methadone, nalbuphine, propoxyphene, and pentazocine, or pharmaceutically acceptable salts thereof. The combined administration of the opioid analgesic and the anti-PACAP antibody or antigen binding fragment thereof may increase the analgesic effect elicited thereby.

The present invention further contemplates an isolated nucleic acid sequence or nucleic acid sequences encoding an anti-PACAP antibody or antigen binding fragment described herein, as well as a vector or vectors containing these isolated nucleic acid sequence or sequences.

Additionally, the invention provides a host cell comprising these isolated nucleic acid sequence or sequences or the vector or set forth above. The host cell may be a eukaryotic host cell that is mammalian, selected from the group consisting of baby hamster kidney ("BHK") cells; chinese hamster ovary ("CHO") cells; mouse sertoli cells ("TM4" cells); African green monkey kidney cells ("VERO-76" cells); human cervical carcinoma ("HELA") cells; canine kidney cells ("MDCK"); buffalo rat liver ("BRL") cells; human lung cells; human liver ("Hep G2") cells; mouse mammary tumor ("MMT") cells; TRI cells; MRC 5 cells; and FS4 cells. Preferably, the mammalian host cell is a CHO cell. More preferably, the mammalian host cell is a CHO K1 cell. The host cell may be a prokaryotic cell, i.e., bacterial cell, or a eukaryotic cell, including a mammalian, fungal, yeast, avian, or insect cell. In one embodiment, the host cell is a filamentous fungus or is a yeast cell. Preferably, the yeast species is of the genus *Pichia*. Most preferably, the species of *Pichia* is selected from *Pichia pastoris, Pichia methanolica*, and *Hansenula polymorpha (Pichia angusta)*.

The invention further provides a method of expressing anti-PACAP antibodies and antigen binding fragments thereof, typically human, humanized, or chimeric antibodies and antigen binding fragments thereof, the method comprising culturing the host cell described herein under conditions that provide for expression of said antibody or antigen binding fragment thereof. The host cell may be a cell culture, such as a Chinese hamster ovary ("CHO") cell or a polyploid yeast culture that stably expresses and secretes into the culture medium at least 10-25 mg/liter of said antibody or antigen binding fragment thereof. The polyploid yeast may be made by a method that comprises: (i) introducing at least one expression vector containing one or more heterologous polynucleotides encoding said antibody operably linked to a promoter and a signal sequence into a haploid yeast cell; (ii) producing by mating or spheroplast fusion a polyploid yeast from said first and/or second haploid yeast cell; (iii) selecting polyploid yeast cells that stably express said antibody; and (iv) producing stable polyploid yeast cultures from said polyploid yeast cells that stably express said antibody into the culture medium. Preferably, the yeast species is of the genus *Pichia*.

In other embodiments, the mammalian cell culture may be made by a method that comprises: (i) introducing at least one expression vector containing one or more heterologous polynucleotides encoding said antibody operably linked to a promoter and a signal sequence into a mammalian cell; (ii) producing single cells for culturing to express one or more heterologous polynucleotides encoding said antibody; (iii) selecting a mammalian cell that stably expresses said antibody; and (iv) producing cell cultures from said mammalian cell that stably expresses said antibody into the culture medium. Preferably, the mammalian species are CHO cells.

The invention further relates to the therapeutic and diagnostic uses of anti-PACAP antibodies and antigen binding fragments thereof, preferably a human antibody, humanized antibody, or chimeric antibody, or a fragment thereof.

In one embodiment, the invention provides a method for blocking, inhibiting, or neutralizing one or more biological effects associated with PACAP in a subject comprising administering to a subject an effective amount of a human or humanized or chimerized anti-PACAP antibody or antigen binding fragment thereof that antagonizes, inhibits, neutralizes, or blocks at least one biological effect associated with human PACAP. In a specific embodiment, the method employs an anti-PACAP antibody or antigen binding fragment thereof that specifically binds to the same or overlapping linear or conformational epitope(s) and/or competes for binding to the same or overlapping linear or conformational epitope(s) on human PACAP as an anti-PACAP antibody selected from Ab1.H, Ab3.H, Ab4.H, Ab5.H, Ab9.H, or Ab12.H.

In another embodiment, the invention provides a method for blocking, inhibiting, or neutralizing one or more biological effects associated with PACAP in a subject comprising administering to a subject an effective amount of a human, humanized, or chimerized anti-PACAP antibody or antigen binding fragment thereof that antagonizes, inhibits, neutralizes, or blocks at least one biological effect associated with human PACAP and that does not substantially interact with (bind) VIP, e.g., the anti-PACAP antibody or antigen binding fragment thereof has stronger affinity for PACAP as compared to VIP, i.e., although there is some cross-reactivity, the antibodies preferentially bind to PACAP as compared to VIP. For example, the affinity of said antibody or antigen binding fragment thereof to PACAP is at least 10-fold, 30-fold, 100-fold, 300-fold, 1000-fold, 3000-fold, 10000-fold, 30000-fold, 100000-fold, 300000-fold, 1000000-fold, 3000000-fold, 10000000-fold, 30000000-fold, or higher than the affinity of said antibody or antigen binding fragment thereof to VIP (e.g., the $K_D$ of said antibody or fragment for binding to human PACAP is 10-fold, 30-fold, 100-fold, 300-fold, 1000-fold, 3000-fold, 10000-fold, 30000-fold, 100000-fold, 300000-fold, 1000000-fold, 3000000-fold, 10000000-fold, 30000000-fold, or lower than the $K_D$ for binding to VIP). In a specific embodiment, the method employs an anti-PACAP antibody or antigen binding fragment thereof that specifically binds to the same or overlapping linear or conformational epitope(s) and/or competes for binding to the same or overlapping linear or conformational epitope(s) on human PACAP as an anti-PACAP antibody selected from Ab1.H, Ab3.H, Ab4.H, Ab5.H, Ab9.H, or Ab12.H.

In yet another embodiment, the invention provides a method for blocking, inhibiting, or neutralizing one or more biological effects associated with PACAP in a subject comprising administering to a subject an effective amount of a human, humanized, or chimerized anti-PACAP antibody or antigen binding fragment thereof that inhibits or neutralizes at least one biological effect elicited by PACAP; neutralizes or inhibits PACAP activation of at least one of PAC1-R, VPAC1-R, and/or VPAC2-R; neutralizes or inhibits PACAP activation of each of PAC1-R, VPAC1-R, and VPAC2-R; neutralizes or inhibits PACAP activation of PAC1-R; is capable of inhibiting PACAP binding to at least one of PAC1-R, VPAC1-R, and/or VPAC2-R; is capable of inhibiting PACAP binding to each of PAC1-R, VPAC1-R, and/or VPAC2-R; is capable of inhibiting PACAP binding to PAC1-R; and/or is capable of inhibiting PACAP binding to the cell surface, e.g., via a GAG; inhibits PACAP-induced cAMP production; and/or when administered to a subject reduces PACAP-induced vasodilation, photophobia, mast cell degranulation, and/or neuronal activation. In a specific embodiment, the method employs an anti-PACAP antibody or antigen binding fragment thereof that specifically binds to the same or overlapping linear or conformational epitope(s) and/or competes for binding to the same or overlapping linear or conformational epitope(s) on human PACAP as an anti-PACAP antibody selected from Ab1.H, Ab3.H, Ab4.H, Ab5.H, Ab9.H, or Ab12.H.

In another embodiment, the invention provides a method for treating or preventing the onset, frequency, severity, or duration of headache or migraine in a subject comprising administering to a subject an effective amount of a human, humanized, or chimerized anti-PACAP antibody or antigen binding fragment thereof that inhibits or neutralizes at least one biological effect elicited by PACAP; neutralizes or inhibits PACAP activation of at least one of PAC1-R, VPAC1-R, and/or VPAC2-R; neutralizes or inhibits PACAP activation of each of PAC1-R, VPAC1-R, and VPAC2-R; neutralizes or inhibits PACAP activation of PAC1-R; is capable of inhibiting PACAP binding to at least one of PAC1-R, VPAC1-R, and/or VPAC2-R; is capable of inhibiting PACAP binding to each of PAC1-R, VPAC1-R, and/or VPAC2-R; is capable of inhibiting PACAP binding to PAC1-R; and/or is capable of inhibiting PACAP binding to the cell surface, e.g., via GAG; inhibits PACAP-induced cAMP production; and/or when administered to a subject reduces PACAP-induced vasodilation, photophobia, mast cell degranulation, and/or neuronal activation. In another embodiment, the invention provides a method for treating or preventing in a human subject an acute, episodic, or chronic condition associated with increased vasodilation, photophobia, mast cell degranulation, and/or neuronal activation.

In a specific embodiment, the method employs an anti-PACAP antibody or antigen binding fragment thereof that specifically binds to the same or overlapping linear or conformational epitope(s) and/or competes for binding to the same or overlapping linear or conformational epitope(s) on human PACAP as an anti-PACAP antibody selected from Ab1.H, Ab3.H, Ab4.H, Ab5.H, Ab9.H, or Ab12.H. The epitope can be identified using an alanine scanning mutation strategy, for example.

In a specific embodiment, the headache or migraine treated and/or prevented by administration of the subject anti-PACAP antibodies and antigen binding fragments thereof is selected from migraine with or without aura, hemiplegic migraine, cluster headache, migrainous neuralgia, chronic headache, and tension headache.

In another specific embodiment, the subject has a ocular disorder associated with photophobia selected from the group consisting of achromatopsia, aniridia, photophobia caused by an anticholinergic drug, aphakia (absence of the lens of the eye), buphthalmos (abnormally narrow angle between the cornea and iris), cataracts, cone dystrophy, congenital abnormalities of the eye, viral conjunctivitis ("pink eye"), corneal abrasion, corneal dystrophy, corneal ulcer, disruption of the corneal epithelium, ectopia lentis, endophthalmitis, eye trauma caused by disease, injury, or infection such as chalazion, episcleritis, glaucoma, keratoconus, or optic nerve hypoplasia, hydrophthalmos, or congenital glaucoma iritis, optic neuritis, pigment dispersion syndrome, pupillary dilation (naturally or chemically induced), retinal detachment, scarring of the cornea or sclera, and uveitis.

In another specific embodiment, the subject has a nervous system-related or neurological condition associated with photophobia selected from the group consisting of autism spectrum disorders, chiari malformation, dyslexia, encephalitis including myalgic encephalomyelitis (also known as "chronic fatigue syndrome"), meningitis, subarachnoid hemorrhage, tumor of the posterior cranial fossa, ankylosing spondylitis, albinism, ariboflavinosis, benzodiazepines (long term use of or withdrawal from benzodiazepines), chemotherapy, chikungunya, cystinosis, Ehlers-Danlos syndrome, hangover, influenza, infectious mononucleosis, magnesium deficiency, mercury poisoning, migraine, rabies, and tyrosinemia type II (also known as "Richner-Hanhart syndrome").

In another specific embodiment, the subject has a photophobia-associated disorder selected from the group consisting of migraine (with or without aura), iritis, uveitis, meningitis, depression, bipolar disorder, cluster headache or anther trigeminal autonomic cephalalgia ("TAC") or blepharospasm, depression, agoraphobia, Post-Traumatic Stress Disorder ("PTSD"), traumatic brain injury, and bipolar disorder.

In another embodiment, the invention provides a method for neutralizing PACAP-induced PAC1-R, VPAC1-R, and/or VPAC2-R signaling, comprising administering to a subject in need thereof an effective amount of an anti-PACAP antibody or antigen binding fragment thereof that specifically binds to the same or overlapping linear or conformational epitope(s) and/or competes for binding to the same or overlapping linear or conformational epitope(s) on human PACAP as an anti-PACAP antibody selected from Ab1.H, Ab3.H, Ab4.H, Ab5.H, Ab9.H, or Ab12.H.

In another embodiment, the invention provides a method for inhibiting PACAP-induced cAMP production, comprising administering to a subject in need thereof an effective amount of an anti-PACAP antibody or antigen binding fragment thereof that specifically binds to the same or overlapping linear or conformational epitope(s) and/or competes for binding to the same or overlapping linear or conformational epitope(s) on human PACAP as an anti-PACAP antibody selected from Ab1.H, Ab3.H, Ab4.H, Ab5.H, Ab9.H, or Ab12.H.

In yet another embodiment, the invention provides a method for inhibiting PACAP-induced vasodilation, photophobia, mast cell degranulation, and/or neuronal activation, comprising administering to a subject in need thereof an effective amount of an anti-PACAP antibody or antigen binding fragment thereof that specifically binds to the same or overlapping linear or conformational epitope(s) and/or competes for binding to the same or overlapping linear or conformational epitope(s) on human PACAP as an anti-PACAP antibody selected from Ab1.H, Ab3.H, Ab4.H, Ab5.H, Ab9.H, or Ab12.H.

In yet another embodiment, the invention provides a method for treating or preventing a condition associated with elevated PACAP levels in a subject, comprising administering to a subject in need thereof an effective amount of an anti-PACAP antibody or antigen binding fragment thereof that specifically binds to the same or overlapping linear or conformational epitope(s) and/or competes for binding to the same or overlapping linear or conformational epitope(s) on human PACAP as an anti-PACAP antibody selected from Ab1.H, Ab3.H, Ab4.H, Ab5.H, Ab9.H, or Ab12.H. The epitope can be identified using an alanine scanning mutation strategy, for example.

Exemplary anti-PACAP antibodies and antigen binding fragments thereof suitable for use in this invention comprise a $V_H$ chain having an amino acid sequence with at least 80, 85, 90, 95, 96, 97, 98, 99 or 100% sequence identity to a $V_H$ chain selected from SEQ ID NO: 1122; 1082; 1002; 1162; and 1042, and/or a $V_L$ chain having an amino acid sequence with at least 80, 85, 90, 95, 96, 97, 98, 99, or 100% sequence identity to a $V_L$ chain selected from selected from SEQ ID NO: 1142; 1102; 1022; 1182; 1062; and/or at least 2, 3, 4, 5, or all 6 CDRs comprised therein.

In one embodiment, the anti-PACAP antibody or antigen binding fragment thereof employed in the methods binds to PACAP27 and/or PACAP38 and blocks PACAP27 and/or PACAP38 binding to PAC1-R, VPAC1-R, and/or VPAC2-R. In another embodiment, the anti-PACAP antibody or antigen binding fragment thereof employed in the methods binds to PACAP27 and/or PACAP38 and blocks PACAP27 and/or PACAP38 binding to each of PAC1-R, VPAC1-R, and VPAC2-R. Preferably, the anti-PACAP antibody or antigen binding fragment thereof binds to PACAP27 and/or PACAP38 and blocks PACAP27 and/or PACAP38 binding to PAC1-R.

More particularly, anti-PACAP antibodies and antigen binding fragments thereof employed in the methods according to the invention may include human, humanized, and chimerized antibodies and fragments thereof, as well as scFvs, camelbodies, shark antibodies, nanobodies, IgNAR, Fab fragments, Fab' fragments, MetMab like antibodies, bispecific antibodies, monovalent antibody fragments, and F(ab')$_2$ fragments. Additionally, the anti-PACAP antibody or antigen binding fragment thereof employed by the methods according to the invention may substantially or entirely lack N-glycosylation and/or O-glycosylation. In one embodiment, the anti-PACAP antibody or antigen binding fragment thereof used in the encompassed methods comprises a human constant domain, e.g., an IgG1, IgG2, IgG3, or IgG4 antibody. In another embodiment, the anti-PACAP antibody or antigen binding fragment thereof comprises an Fc region that has been modified to alter (enhance or impair) at least one of effector function, half-life, proteolysis, or glycosylation. For example, the Fc region may contain one or more mutations that alters or eliminates N- and/or O-glycosylation.

In one embodiment, the subject methods employ an anti-PACAP antibody or antigen binding fragment thereof that binds to PACAP with a $K_D$ of less than or equal to $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, or $10^{-13}$ M. Preferably, the human, humanized, or chimerized anti-PACAP antibody or antigen binding fragment thereof binds to PACAP with a $K_D$ of less than or equal to $5\times10^{-10}$ M, $10^{-10}$ M, $5\times10^{-11}$ M, $10^{-11}$ M, $5\times10^{-12}$ M, or $10^{-12}$ M. More preferably, the methods employ a human, humanized, or chimerized anti-PACAP antibody or antigen binding fragment thereof that binds to PACAP with a $K_D$ that is less than about 100 nM, less than about 40 nM, less than about 1 nM, less than about 100 pM, less than about 50 pM, or less than about 25 pM. Alternatively, the anti-PACAP antibody or antigen binding fragment thereof binds to PACAP with a $K_D$ that is between about 10 pM and about 100 pM. In another embodiment, the human, humanized or chimerized anti-PACAP antibody or antigen binding fragment thereof binds to PACAP with an off-rate ($k_{off}$) of less than or equal to $5\times10^{-4}$ s$^{-1}$, $10^{-4}$ s$^{-1}$, $5\times10^{-5}$ s$^{-1}$, or $10^{-5}$ s$^{-1}$.

In another embodiment, the anti-PACAP antibody or antigen binding fragment thereof used in the subject methods is directly or indirectly attached to another moiety, such as a detectable label or therapeutic agent; is attached to at least one effector moiety, e.g., which comprises a chemical linker; and/or is attached to one or more detectable moieties, e.g., which comprises a fluorescent dye, enzyme, substrate, bioluminescent material, radioactive material, chemiluminescent moiety, or mixtures thereof; and/or is attached to one or more functional moieties.

In another embodiment, the method further comprises administering separately or co-administering another agent, e.g., selected from a chemotherapeutic, an analgesic, an anti-inflammatory, an immunosuppressant, a cytokine, an antiproliferative, and an antiemetic. Preferably, the other therapeutic agent is an analgesic, e.g., an NSAID (such as a cyclooxygenase 1 and/or cyclooxygenase 2 inhibitor; propionic acid derivatives including ibuprofen, naproxen, naprosyn, diclofenac, and ketoprofen; acetic acid derivatives including tolmetin and sulindac; fenamic acid derivatives including mefenamic acid and meclofenamic acid; biphenylcarboxylic acid derivatives including diflunisal and flufenisal; and oxicams including piroxim, sudoxicam, and isoxicam), an opioid analgesic (such as morphine or a morphine derivative or pharmaceutically acceptable salt thereof; codeine, dihydrocodeine, diacetylmorphine, hydrocodone, hydromorphone, levorphanol, oxymorphone, alfentanil, buprenorphine, butorphanol, fentanyl, sufentanil, meperidine, methadone, nalbuphine, propoxyphene and pentazocine or pharmaceutically acceptable salts thereof), another antibody (such as an anti-NGF antibody or antibody fragment or an anti-CGRP or anti-CGRP receptor ("anti-CGRP-R") antibody or antibody fragment), or a non-antibody biologic, e.g., BOTOX®.

In one embodiment, the combined administration of the opioid analgesic and the anti-PACAP antibody or antigen binding fragment thereof increase the analgesic effect as compared to either the opioid analgesic or the anti-PACAP antibody or antigen binding fragment thereof administered alone.

In another embodiment, the subject has previously been treated ("a treated subject") and received an anti-CGRP or anti-CGRP-R antibody or antibody fragment thereof. The treated subject may be a migraineur who did not adequately respond to anti-CGRP or anti-CGRP-R antibody treatment ("poor responder"). Alternatively, the treated subject may have previously received at least one anti-CGRP or anti-CGRP-R antibody or antibody fragment thereof administration, and has elicited an immune response to said antibody or antibody fragment thereof. Exemplary anti-CGRP and anti-CGRP-R antibodies and antibody fragments thereof are disclosed in U.S. Pat. Nos. 9,102,731; 9,115,194; 8,734,802; 8,623,366; 8,597,649; and 8,586,045; and U.S. Patent Application Publication No.'s 20120294822, 20120294802, and 20120294797, the contents of each which are incorporated by reference in their entireties herein.

An aspect of the present invention in general relates to anti-PACAP antibodies and antigen binding fragments thereof, preferably human, humanized, or chimerized anti-human PACAP antibodies or antibody fragments thereof that may specifically bind to the same or overlapping linear or conformational epitope(s) on human PACAP as an anti-PACAP antibody selected from Ab3.H, Ab4.H, Ab5.H, Ab9, Ab9.H and Ab12.H. Moreover, the invention generally pertains to anti-PACAP antibodies and antigen binding fragments thereof that may include human, humanized or chimerized anti-PACAP antibodies or antibody fragments thereof that may specifically bind to the same or overlapping linear or conformational epitope(s) on human PACAP as Ab9 or Ab9.H. Additionally, an embodiment of the invention relates to anti-PACAP antibodies and antigen binding fragments thereof, preferably human, humanized, or chimerized anti-human PACAP antibodies or antibody fragments thereof, which may not substantially interact with (bind) VIP.

In another embodiment, the anti-PACAP antibodies and antigen binding fragments thereof of the invention may include human, humanized or chimerized anti-PACAP antibodies or antibody fragments thereof that may comprise or may elicit one of the following effects: (a) inhibit or neutralize at least one biological effect elicited by PACAP; (b) neutralize or inhibit PACAP activation of at least one of PAC1 receptor ("PAC1-R"), vasoactive intestinal peptide receptor type 1 ("VPAC1-R"), and/or vasoactive intestinal peptide receptor type 2 ("VPAC2-R"); (c) neutralize or inhibit PACAP activation of each of PAC1-R, VPAC1-R, and VPAC2-R; (d) neutralize or inhibit PACAP activation of PAC1-R; (e) inhibit PACAP binding to at least one of PAC1-R, VPAC1-R, and/or VPAC2-R; (f) inhibit PACAP binding to each of PAC1-R, VPAC1-R, and/or VPAC2-R; (g) inhibit PACAP binding to PAC1-R-expressing cells; (h) inhibit PACAP binding to the cell surface, e.g., via a glycosaminoglycan ("GAG") (i) not inhibit PACAP-mediated binding of such antibody to the cell surface, e.g., via a GAG (j) inhibit PACAP-mediated binding of such antibody to the cell surface, presumably via a GAG (k) inhibit PACAP-induced cAMP production; and/or (l) when administered to a subject, reduce PACAP-induced vasodilation, photophobia, mast cell degranulation and/or neuronal activation.

The invention additionally embraces anti-PACAP antibodies and antigen binding fragments thereof, preferably human, humanized or chimerized anti-PACAP antibodies or antibody fragments thereof, that may be suitable for treating a human subject having an acute, episodic or chronic condition associated with increased vasodilation, photophobia, mast cell degranulation and/or neuronal activation. An additional embodiment of the invention relates to anti-PACAP antibodies and antigen binding fragments thereof, preferably human, humanized or chimerized anti-PACAP antibodies or antibody fragments thereof, that may specifically bind to the same or overlapping linear or conformational epitope(s) on human PACAP as Ab9.H, e.g., said antibody or antibody fragment thereof interacts with at least 1, 2, 3, 4, 5 or all 6 of residues 7, 10, 12, 13, 14 and 17 of human PACAP.

Another embodiment of the invention encompasses anti-PACAP antibodies and antigen binding fragments thereof, preferably human, humanized or chimerized anti-PACAP antibodies or antibody fragments thereof, that may comprise the heavy chain CDR2 of Ab3.H. In another embodiment, the anti-PACAP antibodies and antigen binding fragments thereof, preferably human, humanized or chimerized anti-PACAP antibodies or antibody fragments thereof, of the invention may comprise at least 2, at least 3, at least 4, at least 5, or all 6 of the CDRs of Ab3.H.

Another embodiment of the invention encompasses anti-PACAP antibodies and antigen binding fragments thereof, preferably human, humanized or chimerized anti-PACAP antibodies or antibody fragments thereof, that may comprise the heavy chain CDR2 of Ab5.H. In another embodiment, the anti-PACAP antibodies and antigen binding fragments thereof, preferably human, humanized or chimerized anti-PACAP antibodies or antibody fragments thereof, of the invention may comprise at least 2, at least 3, at least 4, at least 5, or all 6 of the CDRs of Ab5.H.

In another specific embodiment, the anti-PACAP antibodies and antigen binding fragments thereof according to the invention, are preferably human, humanized, or chimerized anti-PACAP antibodies and antigen binding fragments thereof, and comprise (a) a heavy chain variable region comprising a CDR1 sequence consisting of SEQ ID NO: 804; a CDR2 sequence consisting of SEQ ID NO: 806; and a CDR3 sequence consisting of SEQ ID NO: 808; and/or (b) a light chain variable region comprising a CDR1 sequence consisting of SEQ ID NO: 824; a CDR2 sequence consisting of SEQ ID NO: 826; and a CDR3 sequence consisting of SEQ ID NO: 828. Alternatively, the anti-PACAP antibodies and antigen binding fragments thereof can comprise a variable heavy chain comprising an amino acid sequence with at least 80, 85, 90, 95, 96, 97, 98, or 99% sequence identity to SEQ ID NO: 802, and/or a variable light chain comprising an amino acid sequence with at least 80, 85, 90, 95, 96, 97, 98, or 99% sequence identity to SEQ ID NO: 822. In another embodiment, the anti-PACAP antibodies and antigen binding fragments thereof comprise (a) a heavy chain variable region having the amino acid sequence of SEQ ID NO: 802, and/or (b) a light chain variable region having the amino acid sequence of SEQ ID NO: 822. More specifically, the anti-PACAP antibodies and antigen binding fragments thereof can comprise (a) a heavy chain having the amino acid sequence of SEQ ID NO: 801, and/or (b) a light chain having the amino acid sequence of SEQ ID NO: 821.

In another specific embodiment, the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1124; a CDR2 sequence consisting of SEQ ID NO: 1126; and a CDR3 sequence consisting of SEQ ID NO: 1128; and/or (b) a light chain variable region comprising a CDR1 sequence consisting of SEQ ID NO: 1144; a CDR2 sequence consisting of SEQ ID NO: 1146; and a CDR3 sequence consisting of SEQ ID NO: 1148. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1122, and/or (b) a light chain variable region comprising an amino acid sequence with at least 80, 85, 90, 95, 96, 97, 98, or 99% sequence identity to SEQ ID NO: 1142. In another embodiment, the anti-PACAP antibodies and antigen binding fragments thereof comprise (a) a heavy chain variable region having the amino acid sequence of SEQ ID NO: 1122, and/or (b) a light chain variable region having the amino acid sequence of SEQ ID NO: 1142. More specifically, the anti-PACAP antibodies and antigen binding fragments thereof can comprise (a) a heavy chain having the amino acid sequence of SEQ ID NO: 1121, and/or (b) a light chain having the amino acid sequence of SEQ ID NO: 1141.

In another specific embodiment, the anti-PACAP antibodies and antigen binding fragments thereof according to the invention, are human, humanized, or chimerized anti-PACAP antibodies or antigen binding fragments thereof, and comprise (a) a heavy chain variable region comprising an amino acid sequence with at least 80, 85, 90, 95, 96, 97, 98, or 99% sequence identity to SEQ ID NO: 1082 and comprising a CDR1 sequence consisting of SEQ ID NO: 1084; a CDR2 sequence consisting of SEQ ID NO: 1086; and a CDR3 sequence consisting of SEQ ID NO: 1088; and/or (b) a light chain variable region comprising an amino acid sequence with at least 80, 85, 90, 95, 96, 97, 98, or 99% sequence identity to SEQ ID NO: 1102, and comprising the CDR1 sequence consisting of SEQ ID NO: 1104; a CDR2 sequence consisting of SEQ ID NO: 1106; and a CDR3 sequence consisting of SEQ ID NO: 1108. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1082 and/or (b) a light chain variable region comprising an amino acid sequence with at least 80, 85, 90, 95, 96, 97, 98, or 99% sequence identity to SEQ ID NO: 1102. In another embodiment, the anti-PACAP antibodies and antigen binding fragments thereof comprise (a) a heavy chain variable region having the amino acid sequence of SEQ ID NO: 1082, and/or (b) a light chain variable region having the amino acid sequence of SEQ ID NO: 1102. In another embodiment, the anti-PACAP antibodies and antigen binding fragments thereof comprise (a) the heavy chain comprising an amino acid sequence with at least 80, 85, 90, 95, 96, 97, 98, or 99% sequence identity to SEQ ID NO: 1081, and/or (b) the light chain comprising an amino acid sequence with at least 80, 85, 90, 95, 96, 97, 98, or 99% sequence identity to SEQ ID NO: 1101. More specifically, the anti-PACAP antibodies and antigen binding fragments thereof can comprise (a) a heavy chain having the amino acid sequence of SEQ ID NO: 1081, and/or (b) a light chain having the amino acid sequence of SEQ ID NO: 1101.

In another specific embodiment, the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1004; a CDR2 sequence consisting of SEQ ID NO: 1006; and a CDR3 sequence consisting of SEQ ID NO: 1008; and/or (b) a light chain variable region comprising a CDR1 sequence consisting of SEQ ID NO: 1024; a CDR2 sequence consisting of SEQ ID NO: 1026; and a CDR3 sequence consisting of SEQ ID NO: 1028. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1002, and/or (b) a light chain variable region comprising an amino acid sequence with at least 80, 85, 90, 95, 96, 97, 98, or 99% sequence identity to SEQ ID NO: 1022. In another embodiment, the anti-PACAP antibodies and antigen binding fragments thereof comprise (a) a heavy chain variable region having the amino acid sequence of SEQ ID NO: 1002, and/or (b) a light chain variable region having the amino acid sequence of SEQ ID NO: 1022. More specifically, the anti-PACAP antibodies and antigen binding fragments thereof can comprise (a) a heavy chain having the amino acid sequence of SEQ ID NO: 1001, and/or (b) a light chain having the amino acid sequence of SEQ ID NO: 1021.

In another specific embodiment, the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1164; a CDR2 sequence consisting of SEQ ID NO: 1166; and a CDR3 sequence consisting of SEQ ID NO: 1168; and/or (b) a light chain variable region comprising a CDR1 sequence consisting of SEQ ID NO: 1184; a CDR2 sequence consisting of SEQ ID NO: 1186; and a CDR3 sequence consisting of SEQ ID NO: 1188. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1162 and/or (b) a light chain variable region comprising an amino acid sequence with at least 80, 85, 90, 95, 96, 97, 98, or 99% sequence identity to SEQ ID NO: 1182. In another embodiment, the anti-PACAP antibodies and antigen binding fragments thereof comprise (a) a heavy chain variable region having the amino acid sequence of SEQ ID NO: 1162, and/or (b) a light chain variable region having the amino acid sequence of SEQ ID NO: 1182. More specifically, the anti-PACAP antibodies and antigen binding fragments thereof can comprise (a) a heavy chain having the amino acid sequence of SEQ ID NO: 1161, and/or (b) a light chain having the amino acid sequence of SEQ ID NO: 1181.

In another specific embodiment, the anti-PACAP antibodies and antigen binding fragments thereof according to the invention, are human, humanized, or chimerized anti-PACAP antibodies or antigen binding fragments thereof, and comprise (a) a heavy chain variable region comprising an amino acid sequence with at least 80, 85, 90, 95, 96, 97, 98, or 99% sequence identity to SEQ ID NO: 1042 and comprising the CDR1 sequence consisting of SEQ ID NO: 1044; a CDR2 sequence consisting of SEQ ID NO: 1046; and a CDR3 sequence consisting of SEQ ID NO: 1048; and/or (b) a light chain variable region comprising an amino acid sequence with at least 80, 85, 90, 95, 96, 97, 98, or 99% sequence identity to SEQ ID NO: 1062 and comprising the CDR1 sequence consisting of SEQ ID NO: 1064; a CDR2 sequence consisting of SEQ ID NO: 1066; and a CDR3 sequence consisting of SEQ ID NO: 1068. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1042 and/or (b) a light chain variable region comprising an amino acid sequence with at least 80, 85, 90, 95, 96, 97, 98, or 99% sequence identity to SEQ ID NO: 1062. In another embodiment, the anti-PACAP antibodies and antigen binding fragments thereof comprise (a) a heavy chain variable region having the amino acid sequence of SEQ ID NO: 1042, and/or (b) a light chain variable region having the amino acid sequence of SEQ ID NO: 1062. More specifically, the anti-PACAP antibodies and antigen binding fragments thereof can comprise (a) the heavy chain comprising an amino acid sequence with at least 80, 85, 90, 95, 96, 97, 98, or 99% sequence identity to SEQ ID NO: 1041, and/or (b) the light chain comprising an amino acid sequence with at least 80, 85, 90, 95, 96, 97, 98, or 99% sequence identity to SEQ ID NO: 1061. More specifically, the anti-PACAP antibodies and antigen binding fragments thereof can comprise (a) a heavy chain having the amino acid sequence of SEQ ID NO: 1041, and/or (b) a light chain having the amino acid sequence of SEQ ID NO: 1061.

In an embodiment of the invention, the anti-PACAP antibodies and antigen binding fragments thereof, preferably human, humanized or chimerized anti-PACAP antibodies or antibody fragments thereof, of the invention may bind an epitope of PACAP wherein said epitope bound by said antibody may be identified by alanine scanning, e.g., as disclosed in Example 12 or another art recognized method.

Additionally, the anti-PACAP antibodies and antigen binding fragments of the invention may include human, humanized or chimerized anti-PACAP antibodies or antibody fragments wherein the antibodies or antibody fragments may be selected from the group consisting of scFvs, camelbodies, nanobodies, Immunoglobulin New Antigen Receptor ("IgNAR"), fragment antigen binding ("Fab") fragments, Fab' fragments, MetMab like antibodies, monovalent antibody fragments, and F(ab')2 fragments. In another embodiment, the anti-PACAP antibodies and antigen binding fragments of the invention, preferably human, humanized or chimerized anti-PACAP antibodies or antibody fragments, may substantially or entirely lack N-glycosylation and/or O-glycosylation. Also, the invention embraces an embodiment of the invention wherein the anti-PACAP antibodies and antigen binding fragments of the invention, preferably human, humanized or chimerized anti-PACAP antibodies or antibody fragments, may comprise a human constant domain, e.g. that of an IgG1, IgG2, IgG3, or IgG4 antibody or fragment thereof.

An additional embodiment of the invention relates to anti-PACAP antibodies and antigen binding fragments, preferably human, humanized or chimerized anti-PACAP antibodies or antibody fragments, wherein said antibodies or antibody fragments may comprise an Fc region that has been modified to alter at least one of effector function, half-life, proteolysis, or glycosylation, e.g., wherein the Fc region contains one or more mutations that alters or eliminates N- and/or O-glycosylation, and/or the Fc region may comprise the sequence of any of SEQ ID NO:1244, 1245 or 1246.

In yet another embodiment of the invention, anti-PACAP antibodies and antigen binding fragments, preferably human, humanized or chimerized anti-PACAP antibodies or antibody fragments, may bind to PACAP with a binding affinity ($K_D$) of less than or equal to $5 \times 10^{-5}$ M, $10^{-5}$ M, $5 \times 10^{-6}$ M, $10^{-6}$ M, $5 \times 10^{-7}$ M, $10^{-7}$ M, $5 \times 10^{-8}$ M, $10^{-8}$ M, $5 \times 10^{-9}$ M, $10^{-9}$ M, $5 \times 10^{-10}$ M, $10^{-10}$ M, $5 \times 10^{-11}$ M, $10^{-11}$ M, $5 \times 10^{-12}$ M, $10^{-12}$ M, $5 \times 10^{-13}$ M, or $10^{-13}$ M, e.g., as determined by ELISA, bio-layer interferometry ("BLI"), KINEXA or surface plasmon resonance at 25° or 37° C. Also, another embodiment of the invention pertains to anti-PACAP antibodies and antigen binding fragments, preferably human, humanized or chimerized anti-PACAP antibodies or antibody fragments, wherein said antibodies or antibody fragments may bind to PACAP with a binding affinity ($K_D$) of less than or equal to $5 \times 10^{-10}$ M, $10^{-10}$ M, $5 \times 10^{-11}$ M, $10^{-11}$ M, $5 \times 10^{-12}$ M, or $10^{-12}$ M. Additionally, the anti-PACAP antibodies and antigen binding fragments, preferably human, humanized or chimerized anti-PACAP antibodies or antibody fragments, of the invention may include anti-PACAP antibodies or antibody fragments which bind to PACAP with an off-rate ($k_{off}$) of less than or equal to $5 \times 10^{-4}$ $s^{-1}$, $10^{-4}$ $s^{-1}$, $5 \times 10^{-5}$ $s^{-1}$, or $10^{-5}$ $s^{-1}$.

Another embodiment of the invention relates to anti-PACAP antibodies and antigen binding fragments, preferably human, humanized or chimerized anti-PACAP antibodies or antibody fragments, wherein said antibodies and antibody fragments may be directly or indirectly attached to a detectable label or therapeutic agent.

In yet another embodiment of the invention, anti-PACAP antibodies and antigen binding fragments, preferably human, humanized or chimerized anti-PACAP antibodies or antibody fragments, may bind to PACAP with a $K_D$ of less than about 100 nM; with a $K_D$ of less than about 40 nM; with a $K_D$ of less than about 100 pM; with a $K_D$ of less than about 50 pM; with a $K_D$ of less than about 25 pM; or with a $K_D$ of between about 10 pM and about 100 pM. The invention also embraces anti-PACAP antibodies and antigen binding fragments, preferably human, humanized or chimerized anti-PACAP antibodies or antibody fragments, that may have stronger binding affinity for PACAP as compared to VIP and/or that may not bind to VIP, and/or wherein said antibodies or antibody fragments thereof may have an affinity to PACAP that may be at least 10-fold, 30-fold, 100-fold, 300-fold, 1000-fold, 3000-fold, 10000-fold, 30000-fold, 100000-fold, 300000-fold, 1000000-fold, 3000000-fold, 10000000-fold, 30000000-fold or more stronger than the affinity of said antibody or antibody fragment to VIP.

In another embodiment, the invention pertains to anti-PACAP antibodies and antigen binding fragments, preferably human, humanized or chimerized anti-PACAP antibodies or antibody fragments, that may be attached to at least one effector or functional moiety and/or one or more detectable moieties, e.g., a fluorescent dye, enzyme, substrate, bioluminescent material, radioactive material, chemiluminescent moiety, or mixture thereof.

Another embodiment of the invention relates to anti-idiotypic antibodies that may be produced against anti-PACAP antibodies or antibody fragments, wherein said anti-idiotypic antibodies optionally neutralize one or more biological effects of the anti-PACAP antibody to which it binds. An embodiment of the invention may also related to a method of using said anti-idiotypic antibody to monitor the in vivo levels of said anti-PACAP antibody or antibody fragment in a subject or to neutralize the in vivo effects of said anti-PACAP antibody in a subject.

In yet another embodiment, the invention pertains to a composition that may be suitable for therapeutic, prophylactic, or a diagnostic use, whereby the composition may comprise a therapeutically, prophylactically or diagnostically effective amount of at least one anti-PACAP antibody or antibody fragment or anti-idiotypic antibody, e.g., wherein the composition may be suitable for subcutaneous administration, and/or suitable for intravenous or intramuscular administration. The invention also embraces an embodiment of the invention wherein said composition of at least one anti-PACAP antibody or antibody fragment or anti-idiotypic antibody may be lyophilized, stabilized, and/or formulated for administration by injection. The invention also embraces an embodiment of the invention wherein said composition of at least one anti-PACAP antibody or antibody fragment or anti-idiotypic antibody may comprise a pharmaceutically acceptable diluent, carrier, solubilizer, emulsifier, preservative, or mixture thereof. Said composition of the invention may further comprise at least one other active agent, e.g., wherein the other active agent may be selected from the group consisting of a chemotherapeutic, an analgesic, an anti-inflammatory, an immunosuppressant, a cytokine, an antiproliferative, an antiemetic and/or a cytotoxin.

A further embodiment of the invention embraces an isolated nucleic acid sequence or nucleic acid sequences that may encode an anti-PACAP antibody or antibody fragment or anti-idiotypic antibody, and wherein said isolated nucleic acid sequence or nucleic acid sequences may be contained within a vector or vectors. Additionally, in an embodiment of the invention, a host cell may comprise said isolated nucleic acid sequence or sequences and/or said vector or vectors, wherein said host cell may be a mammalian, bacterial, fungal, yeast, avian, amphibian, plant, CHO, or insect cell. Wherein said host cell may be a filamentous fungus or a yeast, said host cell may be selected from the following genera: *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis*; and *Zygosaccharomyces* preferably *Pichia* and more preferably *Pichia pastoris, Pichia methanolica* or *Hansenula polymorpha (Pichia angusta)*.

The invention also relates to a method of expressing an anti-PACAP antibody or antibody fragment that may comprise culturing any of but not limited to the host cells disclosed herein under conditions that may provide for expression of said antibody or antibody fragment. In another embodiment, the invention also embraces a method of expressing an anti-PACAP antibody or antibody fragment in a host cell wherein the host cell may be a polyploid yeast culture or CHO cell that may stably express and secrete into the culture medium at least 10-25 mg/liter of said antibody or antigen binding fragment. In yet another embodiment, the invention pertains to a method of expressing an anti-PACAP antibody or antibody fragment wherein expression may occur using said polyploid yeast as a host cell, preferably a *Pichia* yeast, and said polyploid yeast cell may be made by a method that comprises: (i) introducing at least one expression vector containing one or more heterologous polynucleotides encoding said antibody operably linked to a promoter and a signal sequence into a haploid yeast cell; (ii) producing by mating or spheroplast fusion a polyploid yeast from said first and/or second haploid yeast cell; (iii) selecting polyploid yeast cells that stably express said antibody; and (iv) producing stable polyploid yeast cultures from said polyploid yeast cells that stably express said antibody into the culture medium.

Another aspect of the invention generally relates to a method that may block, inhibit or neutralize one or more biological effects associated with PACAP in a subject that may comprise administering to a subject in need thereof an effective amount of an anti-PACAP antibody or antigen binding fragment according to the invention. An additional embodiment of the invention relates to a method that may block, inhibit or neutralize one or more biological effects associated with PACAP in a subject that may comprise administering to a subject in need thereof an effective amount of an effective amount of an anti-PACAP antibody or antigen binding fragment according to the invention or a composition according to the invention that may antagonize, inhibit, neutralize, or block at least one biological effect associated with human PACAP and that may not substantially interact with (bind) VIP.

Additionally, the invention pertains to a method that may block, inhibit or neutralize one or more biological effects associated with PACAP in a subject that may comprise administering to a subject in need thereof an effective amount of an anti-PACAP antibody or antigen binding fragment according to the invention or a composition according to the invention that may elicit or may comprise one or more of the following: (a) inhibit or neutralize at least one biological effect elicited by PACAP; (b) neutralize or inhibit PACAP activation of at least one of PAC1 receptor ("PAC1-R"), vasoactive intestinal peptide receptor type 1 ("VPAC1-R"), and/or vasoactive intestinal peptide receptor type 2 ("VPAC2-R"); (c) neutralize or inhibit PACAP activation of each of PAC1-R, VPAC1-R, and VPAC2-R; (d) neutralize or inhibit PACAP activation of PAC1-R; (e) inhibit PACAP binding to at least one of PAC1-R, VPAC1-R, and/or VPAC2-R; (f) inhibit PACAP binding to each of PAC1-R, VPAC1-R, and/or VPAC2-R; (g) inhibit PACAP binding to PAC1-R-expressing cells; (h) inhibit PACAP binding to the cell surface, e.g., via a glycosaminoglycan ("GAG") (i) not inhibit PACAP-mediated binding of such antibody to the cell surface, e.g., via a GAG; (j) inhibit PACAP-mediated binding of such antibody to the cell surface, e.g., via a GAG; (k) inhibit PACAP-induced cyclic adenosine monophosphate ("cAMP") production; and/or (l) when administered to the subject reduce PACAP-induced vasodilation, photophobia, mast cell degranulation and/or neuronal activation.

An additional embodiment of the invention pertains to a method that may treat or prevent the onset, frequency, severity or duration of headache or migraine, e.g., wherein the headache or migraine may be selected from migraine with aura, migraine without aura, hemiplegic migraine, cluster headache, migrainous neuralgia, chronic headache, chronic migraine, medication overuse headache, and tension headache, in a subject that may comprise administering to a subject in need thereof an effective amount of a human, humanized, or chimerized anti-Pituitary Adenylate Cyclase-Activating Polypeptide ("PACAP") antibody or antigen binding fragment according to the invention or a composition according to the invention that may elicit or may comprise one or more of the following: (a) inhibit or neutralize at least one biological effect elicited by PACAP; (b) neutralize or inhibit PACAP activation of at least one of PAC1 receptor ("PAC1-R"), vasoactive intestinal peptide receptor type 1 ("VPAC1-R"), and/or vasoactive intestinal peptide receptor type 2 ("VPAC2-R"); (c) neutralize or inhibit PACAP activation of each of PAC1-R, VPAC1-R, and VPAC2-R; (d) neutralize or inhibit PACAP activation of PAC1-R; (e) inhibit PACAP binding to at least one of PAC1-R, VPAC1-R, and/or VPAC2-R; (f) inhibit PACAP binding to each of PAC1-R, VPAC1-R, and/or VPAC2-R; (g) inhibit PACAP binding to PAC1-R-expressing cells; (h) inhibit PACAP binding to the cell surface, e.g., via a glycosaminoglycan ("GAG") (i) not inhibit PACAP-mediated binding of such antibody to the cell surface, e.g., via a GAG; (j) inhibit PACAP-mediated binding of such antibody to the cell surface, e.g., via a GAG; (k) inhibit PACAP-induced cyclic adenosine monophosphate ("cAMP") production; and/or (l) when administered to the subject reduce PACAP-induced vasodilation, photophobia, mast cell degranulation and/or neuronal activation.

Another embodiment of the invention encompasses a method that may treat a human subject that may have an acute, episodic or chronic condition associated with at least one of increased vasodilation, photophobia, mast cell degranulation and neuronal activation or a combination of any of the aforementioned, wherein said method may comprise administering to a subject in need thereof an effective amount of an anti-PACAP antibody or antigen binding fragment according the invention or a composition according to the invention.

The invention additionally embraces a method that may block, inhibit or neutralize one or more biological effects that may be associated with PACAP that may comprise administering to a subject in need thereof an effective amount of an anti-PACAP antibody or antigen binding fragment thereof that may specifically bind to the same or overlapping linear or conformational epitope(s) and/or may compete for binding to the same or overlapping linear or conformational epitope(s) on human PACAP as an anti-PACAP antibody that may comprise Ab9 or Ab9.H or an anti-Pituitary Adenylate Cyclase-Activating Polypeptide ("PACAP") antibody or antigen binding fragment according to the invention or a composition according to the invention.

The invention additionally embraces a method that may neutralize PACAP-induced PAC1-R, VPAC1-R, and/or VPAC2-R signaling, that may comprise administering to a subject in need thereof an effective amount of an anti-PACAP antibody or antigen binding fragment thereof that may specifically bind to the same or overlapping linear or conformational epitope(s) and/or that may compete for binding to the same or overlapping linear or conformational epitope(s) on human PACAP as an anti-PACAP antibody that may comprise Ab9 or Ab9.H or an anti-PACAP antibody or antigen binding fragment as discussed herein or a composition as discussed herein.

In another embodiment, the invention encompasses a method that may inhibit pituitary adenylate cyclase-activating peptide ("PACAP")-induced cyclic adenosine monophosphate ("cAMP") production, that may comprise administering to a subject in need thereof an effective amount of an anti-PACAP antibody or antigen binding fragment thereof that may specifically bind to the same or overlapping linear or conformational epitope(s) and/or may compete for binding to the same or overlapping linear or conformational epitope(s) on human PACAP as an anti-PACAP antibody that may comprise Ab9 or Ab9.H or an anti-Pituitary Adenylate Cyclase-Activating Polypeptide ("PACAP") antibody or antigen binding fragment as discussed herein or a composition as discussed herein.

Yet another embodiment of the invention relates to a method that may inhibit pituitary adenylate cyclase-activating peptide ("PACAP")-induced vasodilation, that may comprise administering to a subject in need thereof an effective amount of an anti-PACAP antibody or antigen binding fragment thereof that may specifically bind to the same or overlapping linear or conformational epitope(s) and/or may compete for binding to the same or overlapping linear or conformational epitope(s) on human PACAP as an anti-PACAP antibody that may comprise Ab9 or Ab9.H or an anti-Pituitary Adenylate Cyclase-Activating Polypeptide ("PACAP") antibody or antigen binding fragment as discussed herein or a composition as discussed herein.

In another embodiment, the invention pertains to a method that may treat or prevent a condition associated with elevated anti-human pituitary adenylate cyclase-activating peptide ("PACAP") levels in a subject, that may comprise administering to a subject in need thereof an effective amount of an anti-PACAP antibody or antigen binding fragment thereof that may specifically bind to the same or overlapping linear or conformational epitope(s) and/or that may compete for binding to the same or overlapping linear or conformational epitope(s) on human PACAP as an anti-PACAP antibody that may comprise Ab9 or Ab9.H or an anti-Pituitary Adenylate Cyclase-Activating Polypeptide ("PACAP") antibody or antigen binding fragment as discussed herein or a composition as discussed herein.

The invention also relates to any of the methods discussed herein wherein the antibody or antigen binding fragment may be a humanized anti-PACAP antibody or antigen binding fragment that may specifically bind to the same or overlapping linear or conformational epitope(s) on human PACAP as an anti-PACAP antibody that may be selected from Ab3.H, Ab4.H, Ab5.H, Ab9, Ab9.H and Ab12.H. The invention also relates to any of the methods discussed herein wherein the anti-PACAP antibody or antigen binding may not substantially interact with (bind) Vasoactive Intestinal Peptide ("VIP").

The invention additionally pertains to any of the methods discussed herein wherein an antibody or antigen binding fragment may comprise or may elicit one of the following effects: (a) inhibit or neutralize at least one biological effect elicited by PACAP; (b) neutralize or inhibit PACAP activation of at least one of PAC1 receptor ("PAC1-R"), vasoactive intestinal peptide receptor type 1 ("VPAC1-R"), and/or vasoactive intestinal peptide receptor type 2 ("VPAC2-R"); (c) neutralize or inhibit PACAP activation of each of PAC1-R, VPAC1-R, and VPAC2-R; (d) neutralize or inhibit PACAP activation of PAC1-R; (e) inhibit PACAP binding to at least one of PAC1-R, VPAC1-R, and/or VPAC2-R; (f) inhibit PACAP binding to each of PAC1-R, VPAC1-R, and/or VPAC2-R; (g) inhibit PACAP binding to PAC1-R-expressing cells; (h) inhibit PACAP binding to the cell surface, e.g., via a glycosaminoglycan ("GAG") (i) not inhibit PACAP-mediated binding of such antibody to the cell surface, e.g., via a GAG; (j) inhibit PACAP-mediated binding of such antibody to the cell surface, e.g., via a GAG; (k) inhibit PACAP-induced cyclic adenosine monophosphate ("cAMP") production; and/or (l) when administered to the subject reduce PACAP-induced vasodilation, photophobia, mast cell degranulation and/or neuronal activation.

The invention additionally encompasses any of the methods discussed herein wherein the antibody or antigen binding fragment may be suitable for treating a human subject that may have an acute, episodic or chronic condition associated with increased vasodilation, photophobia, mast cell degranulation and/or neuronal activation.

The invention also pertains to any of the methods disclosed herein that may be effected by an anti-PACAP antibody that may be a human antibody or antigen binding fragment thereof; and/or wherein said antibody may be a humanized antibody or antigen binding fragment thereof; and/or wherein said antibody may be a chimeric antibody or antigen binding fragment thereof.

Another embodiment of the invention also relates to any of the methods discussed herein wherein an anti-PACAP antibody or antibody fragment of the invention may bind to PACAP27 and/or PACAP38 and may block PACAP27 and/or PACAP38 binding to PAC1-R, VPAC1-R, and/or VPAC2-R. Another embodiment of the invention pertains to any of the methods discussed herein wherein said anti-PACAP antibody or antibody fragment may bind to PACAP27 and/or PACAP38 and may block PACAP27 and/or PACAP38 binding to each of PAC1-R, VPAC1-R, and VPAC2-R. Yet another embodiment of the invention relates to any of the methods discussed herein wherein said anti-PACAP antibody or antibody fragment may bind to PACAP27 and/or PACAP38 and may block PACAP27 and/or PACAP38 binding to PAC1-R-expressing cells. Additionally, said anti-PACAP antibody or antibody fragment of the invention that may relate to any of the methods disclosed herein may have an affinity to PACAP that may be at least 10-fold, 30-fold, 100-fold, 300-fold, 1000-fold, 3000-fold, 10000-fold, 30000-fold, 100000-fold, 300000-fold, 1000000-fold, 3000000-fold, 10000000-fold, 30000000-fold or more stronger than the affinity of said antibody or antibody fragment to VIP.

The invention embraces a method that may block, inhibit, block or neutralize one or more biological effects associated with PACAP in a subject that may comprise administering to said subject a therapeutically or prophylactically effective amount of a human, humanized or chimerized anti-PACAP antibody or antibody fragment that may antagonize, inhibit, neutralize or blocks at least one biological effect associated with human PACAP, and wherein said subject may have a condition that may be selected from the group consisting of migraine with aura, migraine without aura, hemiplegic migraines, cluster headaches, migrainous neuralgia, chronic headaches, tension headaches, general headaches, hot flush, photophobia, chronic paroxysmal hemicrania, secondary headaches due to an underlying structural problem in the head, secondary headaches due to an underlying structural problem in the neck, cranial neuralgia, sinus headaches, headache associated with sinusitis, allergy-induced headaches, allergy-induced migraines, trigeminal neuralgia, post-herpetic neuralgia, phantom limb pain, fibromyalgia, reflex sympathetic dystrophy, pain, chronic pain, inflammatory pain, post-operative incision pain, post-surgical pain, trauma-related pain, lower back pain, eye pain, tooth pain, complex regional pain syndrome, cancer pain, primary or metastatic bone cancer pain, fracture pain, osteoporotic fracture pain, pain resulting from burn, gout joint pain, pain associated with sickle cell crises, pain associated with temporomandibular disorders, cirrhosis, hepatitis, neurogenic pain, neuropathic pain, nociceptic pain, visceral pain, menstrual pain, ovarialgia, osteoarthritis pain, rheumatoid arthritis pain, diabetic neuropathy, sciatica, dyspepsia, irritable bowel syndrome, inflammatory bowel disease, Crohn's disease, ileitis, ulcerative colitis, renal colic, dysmenorrhea, cystitis, interstitial cystitis, menstrual period, labor, menopause, pancreatitis, schizophrenia, depression, post-traumatic stress disorder ("PTSD"), anxiety disorders, autoimmune diabetes, Sjögren's syndrome, multiple sclerosis, overactive bladder, bronchial hyperreactivity, asthma, stroke, bronchitis, bronchodilation, emphysema, chronic obstructive pulmonary disease ("COPD"), inflammatory dermatitis, adenocarcinoma in glandular tissue, blastoma in embryonic tissue of organs, carcinoma in epithelial tissue, leukemia in tissues that form blood cells, lymphoma in lymphatic tissue, myeloma in bone marrow, sarcoma in connective or supportive tissue, adrenal cancer, AIDS-related lymphoma, anemia, bladder cancer, bone cancer, brain cancer, breast cancer, carcinoid tumors, cervical cancer, chemotherapy, colon cancer, cytopenia, endometrial cancer, esophageal cancer, gastric cancer, head cancer, neck cancer, hepatobiliary cancer, kidney cancer, leukemia, liver cancer, lung cancer, lymphoma, Hodgkin's disease, non-Hodgkin's, nervous system tumors, oral cancer, ovarian cancer, pancreatic cancer, prostate cancer, rectal cancer, skin cancer, stomach cancer, testicular cancer, thyroid cancer, urethral cancer, cancer of bone marrow, multiple myeloma, tumors that metastasize to the bone, tumors infiltrating the nerve and hollow viscus, tumors near neural structures, acne vulgaris, atopic dermatitis, urticaria, keloids, hypertrophic scars and rosacea, endothelial dysfunction, Raynaud's syndrome, coronary heart disease ("CHD"), coronary artery disease ("CAD"), heart failure, peripheral arterial disease ("PAD"), diabetes, pulmonary hypertension ("PH"), connective tissue disorder, allergic dermatitis, psoriasis, pruritus, neurogenic cutaneous redness, erythema, sarcoidosis, shock, sepsis, opiate withdrawal syndrome, morphine tolerance, and epilepsy. Additionally, said subject may have a condition that may be selected from the group consisting of migraine, headache and a pain associated disease or condition, wherein said headache or migraine may selected from the group consisting of migraine with aura, migraine without aura, hemiplegic migraine, cluster headache, migrainous neuralgia, chronic headache, chronic migraine, medication overuse headache, and tension headache. Also, said subject may have a ocular disorder associated with photophobia selected from the group consisting of achromatopsia, aniridia, photophobia caused by an anticholinergic drug, aphakia, buphthalmos, cataracts, cone dystrophy, congenital abnormalities of the eye, viral conjunctivitis, corneal abrasion, corneal dystrophy, corneal ulcer, disruption of the corneal epithelium, ectopia lentis, endophthalmitis, eye trauma caused by disease, eye trauma caused by injury, eye trauma caused by infection, chalazion, episcleritis, glaucoma, keratoconus, optic nerve hypoplasia, hydrophthalmos, congenital glaucoma iritis, optic neuritis, pigment dispersion syndrome, pupillary dilation, retinal detachment, scarring of the cornea, sclera and uveitis. Further, said subject may have a nervous system-related or neurological condition associated with photophobia selected from the group consisting of autism spectrum disorders, Chiari malformation, dyslexia, encephalitis, meningitis, subarachnoid hemorrhage, tumor of the posterior cranial fossa, ankylosing spondylitis, albinism, ariboflavinosis, benzodiazepines, chemotherapy, chikungunya, cystinosis, Ehlers-Danlos syndrome, hangover, influenza, infectious mononucleosis, magnesium deficiency, mercury poisoning, migraine, rabies, and tyrosinemia type II. Additionally, said subject may have a photophobia associated disorder selected from the group consisting of migraine with aura, migraine without aura, iritis, uveitis, meningitis, depression, bipolar disorder, cluster headache or anther trigeminal autonomic cephalalgia ("TAC") or blepharospasm, depression, agoraphobia and bipolar disorder.

Another embodiment of the invention generally relates to any method discussed herein wherein the antibody of any of the methods may be a human, humanized, or chimerized anti-PACAP antibody or antigen binding fragment thereof. Additionally, the invention may pertain to any of the methods disclosed herein wherein the antibody or antigen binding fragment of any of the methods may specifically bind to the same or overlapping linear or conformational epitope(s) on human PACAP as Ab9 or Ab9.H, e.g., the antibody or antigen binding fragment may interact with at least 1, 2, 3, 4, 5 or all 6 of residues 7, 10, 12, 13, 14 and 17 of human PACAP.

Additionally, the invention may pertain to any of the methods disclosed herein wherein the antibody or antigen binding fragment may comprise the heavy chain CDR2 of Ab3.H; and/or wherein said antibody or antigen binding fragment may comprises at least 2, at least 3, at least 4, at least 5, or all 6 of the CDRs of Ab3.H.

Additionally, the invention may pertain to any of the methods disclosed herein wherein the antibody or antigen binding fragment may comprise the heavy chain CDR2 of Ab5.H; and/or wherein said antibody or antigen binding fragment may comprises at least 2, at least 3, at least 4, at least 5, or all 6 of the CDRs of Ab5.H.

In another specific embodiment, the invention also embraces any of the methods disclosed herein wherein the anti-PACAP antibodies and antigen binding fragments thereof according to the invention, are preferably human, humanized, or chimerized anti-PACAP antibodies and antigen binding fragments thereof, and comprise (a) a heavy chain variable region comprising a CDR1 sequence consisting of SEQ ID NO: 804; a CDR2 sequence consisting of SEQ ID NO: 806; and a CDR3 sequence consisting of SEQ ID NO: 808; and/or (b) a light chain variable region comprising a CDR1 sequence consisting of SEQ ID NO: 824; a CDR2 sequence consisting of SEQ ID NO: 826; and a CDR3 sequence consisting of SEQ ID NO: 828. Alternatively, the anti-PACAP antibodies and antigen binding fragments thereof can comprise a variable heavy chain comprising an amino acid sequence with at least 80, 85, 90, 95, 96, 97, 98, or 99% sequence identity to SEQ ID NO: 802, and/or a variable light chain comprising an amino acid sequence with at least 80, 85, 90, 95, 96, 97, 98, or 99% sequence identity to SEQ ID NO: 822. In another embodiment, the anti-PACAP antibodies and antigen binding fragments thereof comprise (a) a heavy chain variable region having the amino acid sequence of SEQ ID NO: 802, and/or (b) a light chain variable region having the amino acid sequence of SEQ ID NO: 822. More specifically, the anti-PACAP antibodies and antigen binding fragments thereof can comprise (a) a heavy chain having the amino acid sequence of SEQ ID NO: 801, and/or (b) a light chain having the amino acid sequence of SEQ ID NO: 821.

In another specific embodiment, the invention also embraces any of the methods disclosed herein wherein the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1124; a CDR2 sequence consisting of SEQ ID NO: 1126; and a CDR3 sequence consisting of SEQ ID NO: 1128; and/or (b) a light chain variable region comprising a CDR1 sequence consisting of SEQ ID NO: 1144; a CDR2 sequence consisting of SEQ ID NO: 1146; and a CDR3 sequence consisting of SEQ ID NO: 1148. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1122, and/or (b) a light chain variable region comprising an amino acid sequence with at least 80, 85, 90, 95, 96, 97, 98, or 99% sequence identity to SEQ ID NO: 1142. In another embodiment, the anti-PACAP antibodies and antigen binding fragments thereof comprise (a) a heavy chain variable region having the amino acid sequence of SEQ ID NO: 1122, and/or (b) a light chain variable region having the amino acid sequence of SEQ ID NO: 1142. More specifically, the anti-PACAP antibodies and antigen binding fragments thereof can comprise (a) a heavy chain having the amino acid sequence of SEQ ID NO: 1121, and/or (b) a light chain having the amino acid sequence of SEQ ID NO: 1141.

In another specific embodiment, the invention also embraces any of the methods disclosed herein wherein the anti-PACAP antibodies and antigen binding fragments thereof according to the invention, are human, humanized, or chimerized anti-PACAP antibodies or antigen binding fragments thereof, and comprise (a) a heavy chain variable region comprising an amino acid sequence with at least 80, 85, 90, 95, 96, 97, 98, or 99% sequence identity to SEQ ID NO: 1082 and comprising a CDR1 sequence consisting of SEQ ID NO: 1084; a CDR2 sequence consisting of SEQ ID NO: 1086; and a CDR3 sequence consisting of SEQ ID NO: 1088; and/or (b) a light chain variable region comprising an amino acid sequence with at least 80, 85, 90, 95, 96, 97, 98, or 99% sequence identity to SEQ ID NO: 1102 and comprising the CDR1 sequence consisting of SEQ ID NO: 1104; a CDR2 sequence consisting of SEQ ID NO: 1106; and a CDR3 sequence consisting of SEQ ID NO: 1108. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1082 and/or (b) a light chain variable region comprising an amino acid sequence with at least 80, 85, 90, 95, 96, 97, 98, or 99% sequence identity to SEQ ID NO: 1102. In another embodiment, the anti-PACAP antibodies and antigen binding fragments thereof comprise (a) a heavy chain variable region having the amino acid sequence of SEQ ID NO: 1082, and/or (b) a light chain variable region having the amino acid sequence of SEQ ID NO: 1102. In another embodiment, the anti-PACAP antibodies and antigen binding fragments thereof comprise (a) the heavy chain comprising an amino acid sequence with at least 80, 85, 90, 95, 96, 97, 98, or 99% sequence identity to SEQ ID NO: 1081, and/or (b) the light chain comprising an amino acid sequence with at least 80, 85, 90, 95, 96, 97, 98, or 99% sequence identity to SEQ ID NO: 1101. More specifically, the anti-PACAP antibodies and antigen binding fragments thereof can comprise (a) a heavy chain having the amino acid sequence of SEQ ID NO: 1081, and/or (b) a light chain having the amino acid sequence of SEQ ID NO: 1101.

In another specific embodiment, the invention also embraces any of the methods disclosed herein wherein the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1004; a CDR2 sequence consisting of SEQ ID NO: 1006; and a CDR3 sequence consisting of SEQ ID NO: 1008; and/or (b) a light chain variable region comprising a CDR1 sequence consisting of SEQ ID NO: 1024; a CDR2 sequence consisting of SEQ ID NO: 1026; and a CDR3 sequence consisting of SEQ ID NO: 1028. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1002, and/or (b) a light chain variable region comprising an amino acid sequence with at least 80, 85, 90, 95, 96, 97, 98, or 99% sequence identity to SEQ ID NO: 1022. In another embodiment, the anti-PACAP antibodies and antigen binding fragments thereof comprise (a) a heavy chain variable region having the amino acid sequence of SEQ ID NO: 1002, and/or (b) a light chain variable region having the amino acid sequence of SEQ ID NO: 1022. More specifically, the anti-PACAP antibodies and antigen binding fragments thereof can comprise (a) a heavy chain having the amino acid sequence of SEQ ID NO: 1001, and/or (b) a light chain having the amino acid sequence of SEQ ID NO: 1021.

In another specific embodiment, the invention also embraces any of the methods disclosed herein wherein the anti-PACAP antibodies and antigen binding fragments thereof according to the invention, are human, humanized, or chimerized anti-PACAP antibodies or antigen binding fragments thereof, and comprise (a) a heavy chain variable region comprising a CDR1 sequence consisting of SEQ ID NO: 1164; a CDR2 sequence consisting of SEQ ID NO: 1166; and a CDR3 sequence consisting of SEQ ID NO: 1168; and/or (b) a light chain variable region comprising a CDR1 sequence consisting of SEQ ID NO: 1184; a CDR2 sequence consisting of SEQ ID NO: 1186; and a CDR3 sequence consisting of SEQ ID NO: 1188. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1162 and/or (b) a light chain variable region comprising an amino acid sequence with at least 80, 85, 90, 95, 96, 97, 98, or 99% sequence identity to SEQ ID NO: 1182. In another embodiment, the anti-PACAP antibodies and antigen binding fragments thereof comprise (a) a heavy chain variable region having the amino acid sequence of SEQ ID NO: 1162, and/or (b) a light chain variable region having the amino acid sequence of SEQ ID NO: 1182. More specifically, the anti-PACAP antibodies and antigen binding fragments thereof can comprise (a) a heavy chain having the amino acid sequence of SEQ ID NO: 1161, and/or (b) a light chain having the amino acid sequence of SEQ ID NO: 1181.

In another specific embodiment, the invention also embraces any of the methods disclosed herein wherein the anti-PACAP antibodies and antigen binding fragments thereof according to the invention, are human, humanized, or chimerized anti-PACAP antibodies or antigen binding fragments thereof, and comprise (a) a heavy chain variable region comprising an amino acid sequence with at least 80, 85, 90, 95, 96, 97, 98, or 99% sequence identity to SEQ ID NO: 1042 and comprising the CDR1 sequence consisting of SEQ ID NO: 1044; a CDR2 sequence consisting of SEQ ID NO: 1046; and a CDR3 sequence consisting of SEQ ID NO: 1048; and/or (b) a light chain variable region comprising an amino acid sequence with at least 80, 85, 90, 95, 96, 97, 98, or 99% sequence identity to SEQ ID NO: 1062 and comprising the CDR1 sequence consisting of SEQ ID NO: 1064; a CDR2 sequence consisting of SEQ ID NO: 1066; and a CDR3 sequence consisting of SEQ ID NO: 1068. Alternatively, the anti-PACAP antibodies and antigen binding fragments thereof can comprise (a) a heavy chain variable region comprising an amino acid sequence with at least 80, 85, 90, 95, 96, 97, 98, or 99% sequence identity to SEQ ID NO: 1042 and/or (b) a light chain variable region comprising an amino acid sequence with at least 80, 85, 90, 95, 96, 97, 98, or 99% sequence identity to SEQ ID NO: 1062. In another embodiment, the anti-PACAP antibodies and antigen binding fragments thereof comprise (a) a heavy chain variable region having the amino acid sequence of SEQ ID NO: 1042, and/or (b) a light chain variable region having the amino acid sequence of SEQ ID NO: 1062. More specifically, the anti-PACAP antibodies and antigen binding fragments thereof can comprise (a) the heavy chain comprising an amino acid sequence with at least 80, 85, 90, 95, 96, 97, 98, or 99% sequence identity to SEQ ID NO: 1041, and/or (b) the light chain comprising an amino acid sequence with at least 80, 85, 90, 95, 96, 97, 98, or 99% sequence identity to SEQ ID NO: 1061. More specifically, the anti-PACAP antibodies and antigen binding fragments thereof can comprise (a) a heavy chain having the amino acid sequence of SEQ ID NO: 1041, and/or (b) a light chain having the amino acid sequence of SEQ ID NO: 1061.

In another embodiment, the invention generally relates to any of the methods discussed herein wherein the epitope bound by said antibody may be identified by alanine scanning, e.g., as disclosed in Example 12 or by another art recognized method.

The invention also relates to any of the methods disclosed herein wherein the anti-PACAP antibodies or antibody fragments may be selected from the group consisting of scFvs, camelbodies, nanobodies, Immunoglobulin New Antigen Receptor ("IgNAR"), fragment antigen binding ("Fab") fragments, Fab' fragments, MetMab like antibodies, monovalent antibody fragments, and F(ab')2 fragments. Additionally, the invention relates to any of the methods disclosed herein wherein the anti-PACAP antibody or antibody fragment may substantially or entirely lack N-glycosylation and/or O-glycosylation. Also, the invention pertains to any of the methods disclosed herein wherein the anti-PACAP antibody or antibody fragment may comprise a human constant domain, e.g., that of an IgG1, IgG2, IgG3, or IgG4 antibody.

Another aspect of the invention pertains to any of the methods disclosed herein wherein the anti-PACAP antibody or antibody fragment may comprise an Fc region that may have been modified to alter at least one of effector function, half-life, proteolysis, or glycosylation, and/or the Fc region may comprise the sequence of any of SEQ ID NO:1244, 1245 or 1246. For example, the Fc region may contain one or more mutations that alters or eliminates N- and/or O-glycosylation.

A further aspect of the invention relates to any of the methods disclosed herein wherein the anti-PACAP antibody or antibody fragment may bind to PACAP with a binding affinity ($K_D$) of less than or equal to $5 \times 10^{-5}$ M, $10^{-5}$ M, $5 \times 10^{-6}$ M, $10^{-6}$ M, $5 \times 10^{-7}$ M, $10^{-7}$ M, $5 \times 10^{-8}$ M, $10^{-8}$ M, 5×10⁻⁹ M, 10⁻⁹ M, 5×10⁻¹⁰ M, 10⁻¹⁰ M, 5×10⁻¹¹ M, 10⁻¹¹ M, 5×10⁻¹² M, 10⁻¹² M, 5×10⁻¹³ M, or 10⁻¹³ M. Also, said anti-PACAP antibody or antibody fragment of any of the methods disclosed herein may bind to PACAP with a binding affinity ($K_D$) of less than or equal to 5×10⁻¹⁰ M, 10⁻¹⁰ M, 5×10⁻¹¹ M, 10⁻¹¹ M, 5×10⁻¹² M, or 10⁻¹² M. Another embodiment of the invention pertains any of the methods disclosed herein wherein the anti-PACAP antibody or antibody fragment may bind to PACAP with an off-rate ($k_{off}$) of less than or equal to 5×10⁻⁴ s⁻¹, 10⁻⁴ s⁻¹, 5×10⁻⁵ s⁻¹, or 10⁻⁵ s⁻¹.

Moreover, the invention embraces any of the methods disclosed herein wherein the anti-PACAP antibody or antibody fragment may be directly or indirectly attached to a detectable label or therapeutic agent. Also, the invention relates to any of the methods disclosed herein wherein the anti-PACAP antibody or antibody fragment may bind to PACAP with a $K_D$ that may be less than about 100 nM, less than about 40 nM, less than about 1 nM, less than about 100 pM, less than about 50 pM, or less than about 25 pM. Also, the invention embraces any of the methods disclosed herein wherein the anti-PACAP antibody or antibody fragment may bind to PACAP with a $K_D$ of between about 10 pM and about 100 pM. The invention further pertains to any of the methods disclosed herein wherein the method may further comprise administering separately or co-administering another agent, e.g., wherein the other agent may be selected from a chemotherapeutic, an analgesic, an anti-inflammatory, an immunosuppressant, a cytokine, an antiproliferative, an antiemetic or a cytotoxin. Also, the invention embraces any of the methods disclosed herein wherein the other therapeutic agent may be an analgesic, and said analgesic may be a non-steroidal anti-inflammatory drug ("NSAID"), an opioid analgesic, another antibody or a non-antibody biologic, and further wherein said other antibody may be an anti-NGF antibody or antibody fragment; and/or may be an anti-Calcitonin Gene-Related Peptide ("CGRP") antibody or antibody fragment and/or an anti-CGRP receptor antibody or antibody fragment. The invention also pertains to any of the methods disclosed herein wherein said NSAID may be a cyclooxygenase 1 and/or cyclooxygenase 2 inhibitor; and/or wherein said NSAID may be selected from the group consisting of (1) propionic acid derivatives including ibuprofen, naproxen, naprosyn, diclofenac, and ketoprofen; (2) acetic acid derivatives including tolmetin and sulindac; (3) fenamic acid derivatives including mefenamic acid and meclofenamic acid; (4) biphenylcarboxylic acid derivatives including diflunisal and flufenisal; and (5) oxicams including piroxim, sudoxicam, and isoxicam. The invention further relates to any of the methods disclosed herein wherein said opioid analgesic may be selected from the group consisting of codeine, dihydrocodeine, diacetylmorphine, hydrocodone, hydromorphone, levorphanol, oxymorphone, alfentanil, buprenorphine, butorphanol, fentanyl, sufentanil, meperidine, methadone, nalbuphine, propoxyphene, pentazocine, and pharmaceutically acceptable salts thereof; and/or wherein the opioid analgesic may be morphine or a morphine derivative or pharmaceutically acceptable salt thereof and/or wherein the combined administration of the opioid analgesic and the anti-PACAP antibody or antigen binding fragment may increase the analgesic effect as compared to either the opioid analgesic or the anti-PACAP antibody or antigen binding fragment administered alone.

The invention additionally relates to any of the methods disclosed herein wherein the antibody or antigen binding fragment may be attached to at least one effector or functional moiety and/or one or more detectable moieties, e.g., a fluorescent dye, enzyme, substrate, bioluminescent material, radioactive material, chemiluminescent moiety, or mixture thereof.

Furthermore, the invention relates to any of the methods disclosed herein wherein a subject of any of the methods disclosed herein may have previously received an anti-CGRP antibody or antibody fragment and/or an anti-CGRP receptor antibody or antibody fragment; and/or wherein said subject may be a migraineur who may have not adequately responded to anti-CGRP antibody and/or an anti-CGRP receptor antibody or antibody fragment treatment; and/or wherein said subject may have previously received at least one anti-CGRP antibody or antibody fragment and/or an anti-CGRP receptor antibody or antibody fragment administration that may have elicited an immune response to the anti-CGRP antibody or antibody fragment and/or the anti-CGRP receptor antibody or antibody fragment.

BRIEF DESCRIPTION OF THE SEVERAL VIEWS OF THE DRAWING

FIGS. 1A-1B provide the polypeptide sequences of the heavy chain variable region for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23 (SEQ ID NO: 2; 42; 82; 682; 1122; 642; 1082; 482; 1002; 722; 522; 762; 802; 1162; 562; 602; 1042; 122; 162; 202; 242; 282; 322; 362; 882; and 922, respectively) aligned by their FRs and CDRs.

FIGS. 2A-2B provide the polypeptide sequences of the light chain variable region for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23 (SEQ ID NO: 22; 62; 102; 702; 1142; 662; 1102; 502; 1022; 742; 542; 782; 822; 1182; 582; 622; 1062; 142; 182; 222; 262; 302; 342; 382; 902; and 942, respectively) aligned by their FRs and CDRs.

FIGS. 3A-3F provide the polynucleotide sequences encoding the heavy chain variable region for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23 (SEQ ID NO: 12; 52; 92; 692; 1132; 652; 1092; 492; 1012; 732; 532; 772; 812; 1172; 572; 612; 1052; 132; 172; 212; 252; 292; 332; 372; 892; and 932, respectively) aligned by their FRs and CDRs.

FIGS. 4A-4E provide the polynucleotide sequences encoding the light chain variable region for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23 (SEQ ID NO: 32; 72; 112; 712; 1152; 672; 1112; 512; 1032; 752; 552; 792; 832; 1192; 592; 632; 1072; 152; 192; 232; 272; 312; 352; 392; 912; and 952, respectively) aligned by their FRs and CDRs.

FIG. 5 provides the polypeptide sequence coordinates for certain antibody heavy chain protein sequence features including the variable region and CDRs of the heavy chain for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23.

FIG. 6 provides the polypeptide sequence coordinates for certain antibody heavy chain protein sequence features including the constant region and framework regions FRs of the heavy chain for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23.

FIG. 7 provides the polypeptide sequence coordinates for certain antibody light chain protein sequence features including the variable region and CDRs of the light chain for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23.

FIG. 8 provides the polypeptide sequence coordinates for certain antibody light chain protein sequence features including the constant region and framework regions FRs of the light chain for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23.

FIG. 9 provides the polynucleotide sequence coordinates for certain antibody heavy chain DNA sequence features including the variable region and CDRs of the heavy chain for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23.

FIG. 10 provides the polynucleotide sequence coordinates for certain antibody heavy chain DNA sequence features including the constant region and FRs of the heavy chain for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23.

FIG. 11 provides the polynucleotide sequence coordinates for certain antibody light chain DNA sequence features including the variable region and CDRs of the light chain for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23.

FIG. 12 provides the polynucleotide sequence coordinates for certain antibody light chain DNA sequence features including the constant region and FRs of the light chain for antibodies Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23.

19G), Ab8-mediated (FIG. 19H), Ab9-mediated (FIG. 19I), Ab10-mediated (FIG. 19J), Ab11-mediated (FIG. 19K), Ab12-mediated (FIG. 19L), Ab13-mediated (FIG. 19M), Ab14-mediated (FIG. 19N), Ab15-mediated (FIG. 19O), Ab16-mediated (FIG. 19P), Ab17-mediated (FIG. 19Q), Ab18-mediated (FIG. 19R), Ab19-mediated (FIG. 19S), Ab1.H-mediated (FIG. 19T), Ab10.H-mediated (FIG. 19U), Ab22-mediated (FIG. 19V), Ab23-mediated (FIG. 19W), Ab3.H-mediated (FIG. 19X), Ab4.H-mediated (FIG. 19Y), Ab5.H-mediated (FIG. 19Z), Ab9.H-mediated (FIG. 19AA), and Ab12.H-mediated (FIG. 19BB) inhibition of PACAP38-driven cAMP production via VPAC2-R-expressing CHO-K1 cells obtained following the protocol in Example 4 infra.

Figure 20:
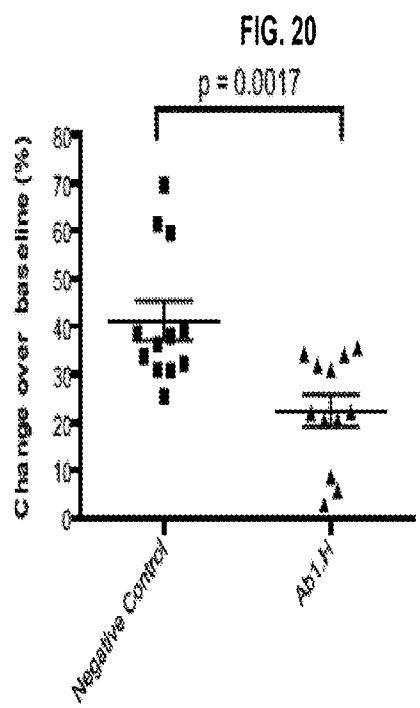

FIG. 20 provides representative data showing a reduction in vasodilation obtained by administering Ab1.H following PACAP38 administration in a rabbit model, relative to a vehicle control, obtained following the protocol in Example 7 infra.

Figure 21:
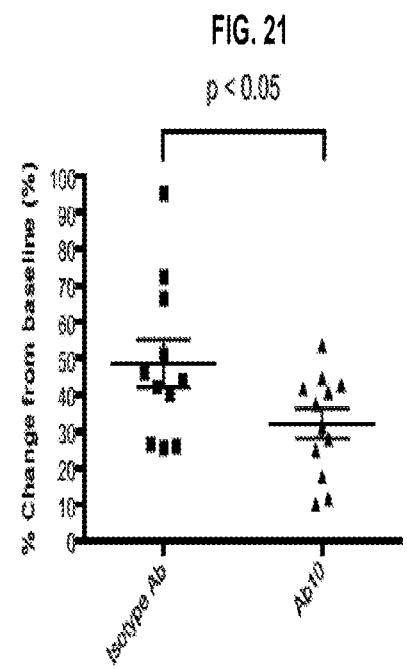

FIG. 21 provides representative data showing a reduction in vasodilation obtained by administering Ab10 following PACAP38 administration in a rabbit model, relative to an isotype antibody control, obtained following the protocol in Example 8 infra.

Figure 22A:
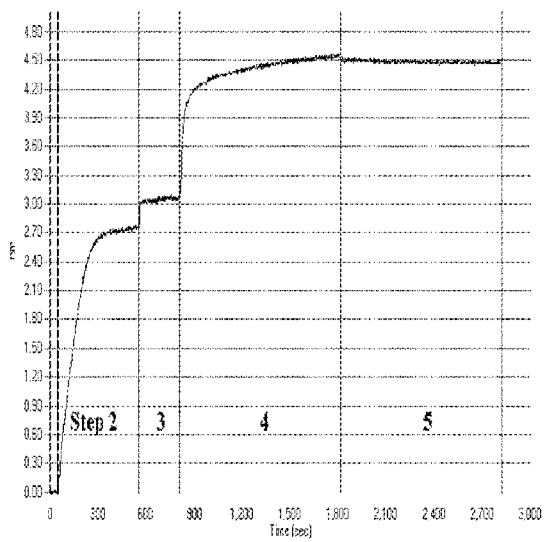

FIG. 22A provides epitope binning data for labeled Ab1 and unlabeled Ab10 obtained following the protocol in Example 9 infra.

Figure 22B:
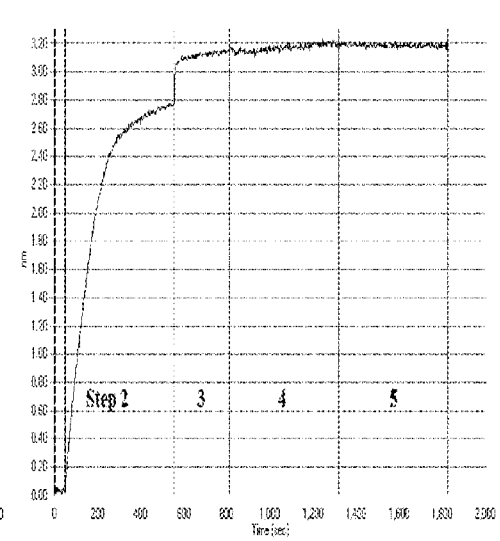

FIG. 22B provides epitope binning data for unlabeled Ab1 and labeled Ab10 obtained following the protocol in Example 9 infra.

FIG. 23 provides representative data showing the in vivo effect of the administration of PACAP and an anti-PACAP antibody Ab1.H in a rodent photophobia model, which model detects the amount of time treated animals (mice) spend in the light per 5 minute intervals compared to appropriate control animals obtained following the protocol in Example 11 infra.

FIG. 24 provides representative data showing the in vivo effect of the administration of PACAP and anti-PACAP antibody Ab1.H in a rodent photophobia animal model, which detects the average amount of time treated animals (mice) spend in the light compared to appropriate control animals obtained following the protocol in Example 11 infra.

FIG. 25 provides representative data showing the in vivo effect of the administration of PACAP and an anti-PACAP antibody Ab10.H in a rodent photophobia model, which model detects the amount of time treated animals (mice) spend in the light compared to appropriate control animals obtained following the protocol in Example 11 infra FIG. 26A presents results of surface plasmon resonance-based binding kinetics measurements for binding of anti-PACAP antibody Ab1 to PACAP alanine scanning mutants 5A, 6A, 8A, 10A, and 13A, along with controls including wild-type PACAP (labelled huPACAP (1-38)) (positive control) and 1× running buffer (negative control) obtained following the protocol in Example 12 infra.

FIG. 26B presents results of surface plasmon resonance-based binding kinetics measurements for binding of anti-PACAP antibody Ab1 to PACAP alanine scanning mutants 1A-4A, 7A, 9A, 11A, 12A, and 14A-38A, along with controls including wild-type PACAP (labelled huPACAP (1-38)) (positive control) and 1× running buffer (negative control) obtained following the protocol in Example 12 infra.

FIG. 27A presents results of surface plasmon resonance-based binding kinetics measurements for binding of anti-PACAP antibody Ab2 to PACAP alanine scanning mutants 5A, 6A, 8A, 9A, 10A, 13A, and 14A, along with controls including wild-type PACAP (labelled huPACAP (1-38)) (positive control) and 1× running buffer (negative control) obtained following the protocol in Example 12 infra.

FIG. 27B presents results of surface plasmon resonance-based binding kinetics measurements for binding of anti-PACAP antibody Ab2 to PACAP alanine scanning mutants 1A-4A, 7A, 11A, 12A, and 15A-38A, along with controls including wild-type PACAP (labelled huPACAP (1-38)) (positive control) and 1× running buffer (negative control) obtained following the protocol in Example 12 infra.

FIG. 28A presents results of surface plasmon resonance-based binding kinetics measurements for binding of anti-PACAP antibody Ab13 to PACAP alanine scanning mutants 6A, 8A, 9A, 10A, and 13A, along with controls including wild-type PACAP (labelled huPACAP (1-38)) (positive control) and 1× running buffer (negative control) obtained following the protocol in Example 12 infra.

FIG. 28B presents results of binding kinetics measurements for binding of anti-PACAP antibody Ab13 to PACAP alanine scanning mutants 1A-5A, 7A, 11A, 12A, and 14A-38A, along with controls including wild-type PACAP (labelled huPACAP (1-38)) (positive control) and 1× running buffer (negative control) obtained following the protocol in Example 12 infra.

FIG. 29A presents results of surface plasmon resonance-based binding kinetics measurements for binding of anti-PACAP antibody Ab14 to PACAP alanine scanning mutants 5A, 6A, 8A, 9A, 10A, and 13A, along with controls including wild-type PACAP (labelled huPACAP (1-38)) (positive control) and 1× running buffer (negative control) obtained following the protocol in Example 12 infra.

FIG. 29B presents results of surface plasmon resonance-based binding kinetics measurements for binding of anti-PACAP antibody Ab14 to PACAP alanine scanning mutants 1A-4A, 7A, 11A, 12A, and 14A-38A, along with controls including wild-type PACAP (labelled huPACAP (1-38)) (positive control) and 1× running buffer (negative control) obtained following the protocol in Example 12 infra.

FIG. 30A presents results of surface plasmon resonance-based binding kinetics measurements for binding of anti-PACAP antibody Ab15 to PACAP alanine scanning mutants 5A, 6A, 8A, 9A, 10A, 12A, 13A, and 14A, along with controls including wild-type PACAP (labelled huPACAP (1-38)) (positive control) and 1× running buffer (negative control) obtained following the protocol in Example 12 infra.

FIG. 30B presents results of surface plasmon resonance-based binding kinetics measurements for binding of anti-PACAP antibody Ab15 to PACAP alanine scanning mutants 1A-4A, 7A, 11A, and 15A-38A, along with controls including wild-type PACAP (labelled huPACAP (1-38)) (positive control) and 1× running buffer (negative control) obtained following the protocol in Example 12 infra.

FIG. 31A presents results of surface plasmon resonance-based binding kinetics measurements for binding of anti-PACAP antibody Ab16 to PACAP alanine scanning mutants 6A, 8A, 10A, and 13A, along with controls including wild-type PACAP (labelled huPACAP (1-38)) (positive control) and 1× running buffer (negative control) obtained following the protocol in Example 12 infra.

FIG. 31B presents results of surface plasmon resonance-based binding kinetics measurements for binding of anti-PACAP antibody Ab16 to PACAP alanine scanning mutants 1A-5A, 7A, 9A, 11A, 12A, and 14A-38A, along with controls including wild-type PACAP (labelled huPACAP (1-38)) (positive control) and 1× running buffer (negative control) obtained following the protocol in Example 12 infra.

FIG. 32A presents results of surface plasmon resonance-based binding kinetics measurements for binding of anti-PACAP antibody Ab17 to PACAP alanine scanning mutants 5A, 6A, 8A, 10A, and 13A, along with controls including wild-type PACAP (labelled huPACAP (1-38)) (positive control) and 1× running buffer (negative control) obtained following the protocol in Example 12 infra.

FIG. 32B presents results of surface plasmon resonance-based binding kinetics measurements for binding of anti-PACAP antibody Ab17 to PACAP alanine scanning mutants 1A-4A, 7A, 9A, 11A, 12A, and 14A-38A, along with controls including wild-type PACAP (labelled huPACAP (1-38)) (positive control) and 1× running buffer (negative control) obtained following the protocol in Example 12 infra.

FIG. 33A presents results of surface plasmon resonance-based binding kinetics measurements for binding of anti-PACAP antibody Ab18 to PACAP alanine scanning mutants 5A, 6A, 8A, 9A, 10A, 12A, and 13A, along with controls including wild-type PACAP (labelled huPACAP (1-38)) (positive control) and 1× running buffer (negative control) obtained following the protocol in Example 12 infra.

FIG. 33B presents results of surface plasmon resonance-based binding kinetics measurements for binding of anti-PACAP antibody Ab18 to PACAP alanine scanning mutants 1A-4A, 7A, 11A, and 14A-38A, along with controls including wild-type PACAP (labelled huPACAP (1-38)) (positive control) and 1× running buffer (negative control) obtained following the protocol in Example 12 infra.

FIG. 34A presents results of surface plasmon resonance-based binding kinetics measurements for binding of anti-PACAP antibody Ab19 to PACAP alanine scanning mutants 4A, 5A, 6A, 8A, 9A, 10A, 12A, 13A, 14A, and 17A, along with controls including wild-type PACAP (labelled huPACAP (1-38)) (positive control) and 1× running buffer (negative control) obtained following the protocol in Example 12 infra.

FIG. 34B presents results of surface plasmon resonance-based binding kinetics measurements for binding of anti-PACAP antibody Ab19 to PACAP alanine scanning mutants 1A-3A, 7A, 11A, 15A, 16A, and 18V-38A, along with controls including wild-type PACAP (labelled huPACAP (1-38)) (positive control) and 1× running buffer (negative control) obtained following the protocol in Example 12 infra.

Figure 35A:
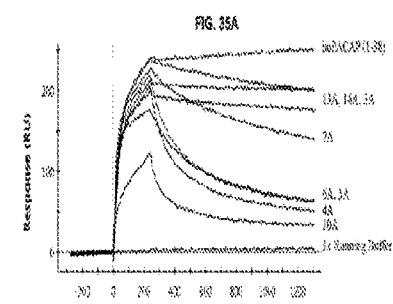

FIG. 35A presents results of surface plasmon resonance-based binding kinetics measurements for binding of anti-PACAP antibody Ab5 to PACAP alanine scanning mutants 3A, 4A, 5A, 6A, 7A, 10A, 13A, and 14A, along with controls including wild-type PACAP (labelled huPACAP (1-38)) (positive control) and 1× running buffer (negative control) obtained following the protocol in Example 12 infra.

Figure 35B:
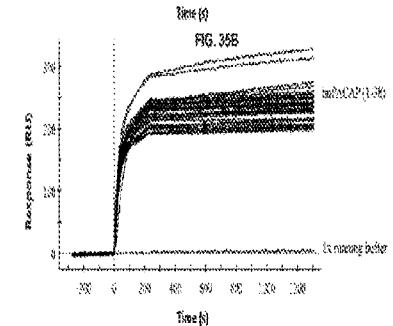

FIG. 35B presents results of surface plasmon resonance-based binding kinetics measurements for binding of anti-PACAP antibody Ab5 to PACAP alanine scanning mutants 1A, 2A, 8A, 9A, 11A, 12A, and 15A-38A, along with controls including wild-type PACAP (labelled huPACAP (1-38)) (positive control) and 1× running buffer (negative control) obtained following the protocol in Example 12 infra.

Figure 36A:
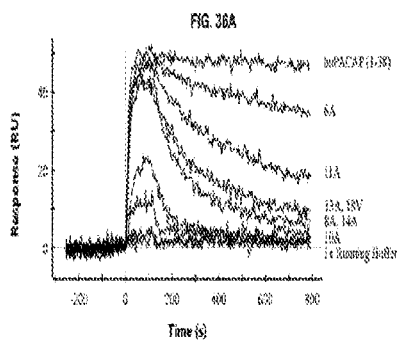

FIG. 36A presents results of surface plasmon resonance-based binding kinetics measurements for binding of anti-PACAP antibody Ab7 to PACAP alanine scanning mutants 6A, 8A, 10A, 11A, 13A, 14A, and 18V, along with controls including wild-type PACAP (labelled huPACAP (1-38)) (positive control) and 1× running buffer (negative control) obtained following the protocol in Example 12 infra.

Figure 36B:
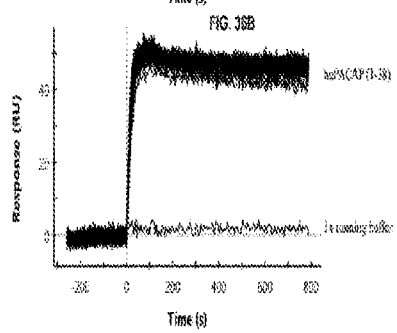

FIG. 36B presents results of surface plasmon resonance-based binding kinetics measurements for binding of anti-PACAP antibody Ab7 to PACAP alanine scanning mutants 1A-5A, 7A, 9A, 12A, 15A-17A, and 19A-38A, along with controls including wild-type PACAP (labelled huPACAP (1-38)) (positive control) and 1× running buffer (negative control) obtained following the protocol in Example 12 infra.

Figure 37A:
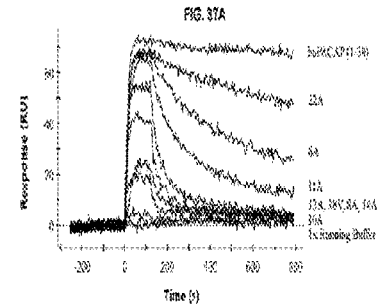

FIG. 37A presents results of surface plasmon resonance-based binding kinetics measurements for binding of anti-PACAP antibody Ab11 to PACAP alanine scanning mutants 6A, 8A, 10A, 11A, 13A, 14A, 18V, and 22A, along with controls including wild-type PACAP (labelled huPACAP (1-38)) (positive control) and 1× running buffer (negative control) obtained following the protocol in Example 12 infra.

Figure 37B:
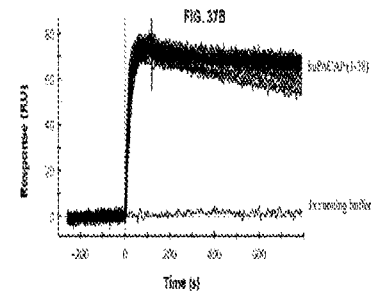

FIG. 37B presents results of surface plasmon resonance-based binding kinetics measurements for binding of anti-PACAP antibody Ab11 to PACAP alanine scanning mutants 1A-5A, 7A, 9A, 12A, 15A-17A, 19A-21A, and 23A-38A, along with controls including wild-type PACAP (labelled huPACAP (1-38)) (positive control) and 1× running buffer (negative control) obtained following the protocol in Example 12 infra.

Figure 38A:
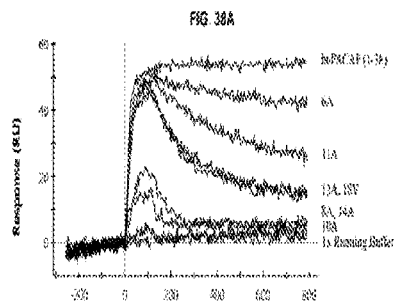

FIG. 38A presents results of surface plasmon resonance-based binding kinetics measurements for binding of anti-PACAP antibody Ab12 to PACAP alanine scanning mutants 6A, 8A, 10A, 11A, 13A, 14A, and 18V, along with controls including wild-type PACAP (labelled huPACAP (1-38)) (positive control) and 1× running buffer (negative control) obtained following the protocol in Example 12 infra.

Figure 38B:
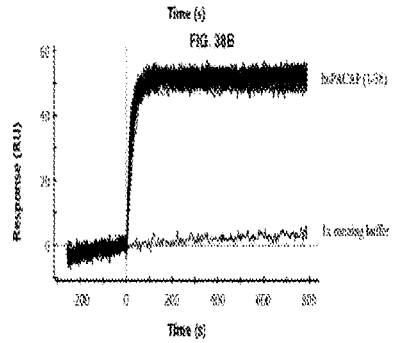

FIG. 38B presents results of surface plasmon resonance-based binding kinetics measurements for binding of anti-PACAP antibody Ab12 to PACAP alanine scanning mutants 1A-5A, 7A, 9A, 12A, 15A-17A, and 19A-38A, along with controls including wild-type PACAP (labelled huPACAP (1-38)) (positive control) and 1× running buffer (negative control) obtained following the protocol in Example 12 infra.

Figure 39A:
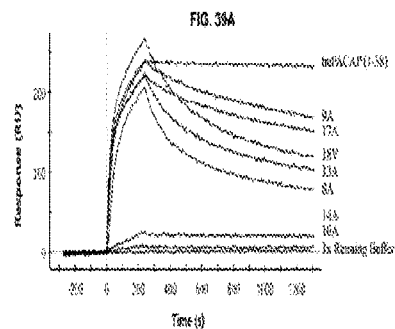

FIG. 39A presents results of surface plasmon resonance-based binding kinetics measurements for binding of anti-PACAP antibody Ab4 to PACAP alanine scanning mutants 8A, 9A, 10A, 13A, 14A, 17A, and 18V, along with controls including wild-type PACAP (labelled huPACAP (1-38)) (positive control) and 1× running buffer (negative control) obtained following the protocol in Example 12 infra.

Figure 39B:
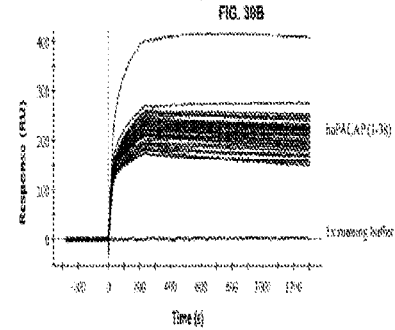

FIG. 39B presents results of surface plasmon resonance-based binding kinetics measurements for binding of anti-PACAP antibody Ab4 to PACAP alanine scanning mutants 1A-7A, 11A, 12A, 15A, 16A, and 19A-38A, along with controls including wild-type PACAP (labelled huPACAP (1-38)) (positive control) and 1× running buffer (negative control) obtained following the protocol in Example 12 infra.

Figure 40A:
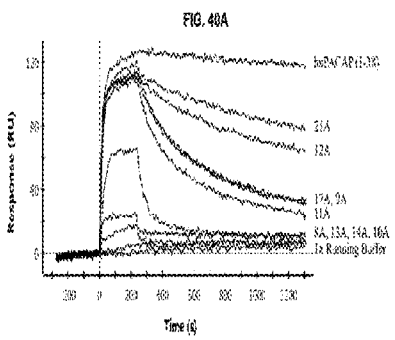

FIG. 40A presents results of surface plasmon resonance-based binding kinetics measurements for binding of anti-PACAP antibody Ab3 to PACAP alanine scanning mutants 8A, 9A, 10A, 11A, 12A, 13A, 14A, 17A, and 21A, along with controls including wild-type PACAP (labelled huPACAP (1-38)) (positive control) and 1× running buffer (negative control) obtained following the protocol in Example 12 infra.

Figure 40B:
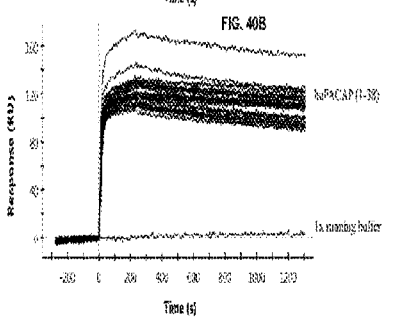

FIG. 40B presents results of surface plasmon resonance-based binding kinetics measurements for binding of anti-PACAP antibody Ab3 to PACAP alanine scanning mutants 1A-7A, 15A, 16A, 18A-20A, and 22A-38A, along with controls including wild-type PACAP (labelled huPACAP (1-38)) (positive control) and 1× running buffer (negative control) obtained following the protocol in Example 12 infra.

Figure 41A:
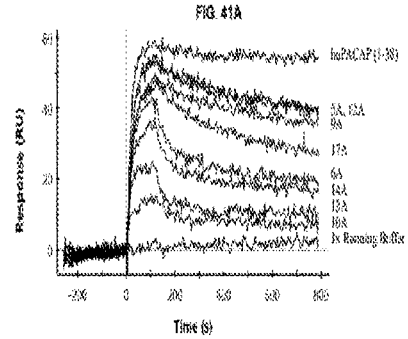

FIG. 41A presents results of surface plasmon resonance-based binding kinetics measurements for binding of anti-PACAP antibody Ab6 to PACAP alanine scanning mutants 5A, 6A, 9A, 10A, 12A, 13A, 14A, and 17A, along with controls including wild-type PACAP (labelled huPACAP (1-38)) (positive control) and 1× running buffer (negative control) obtained following the protocol in Example 12 infra.

Figure 41B:
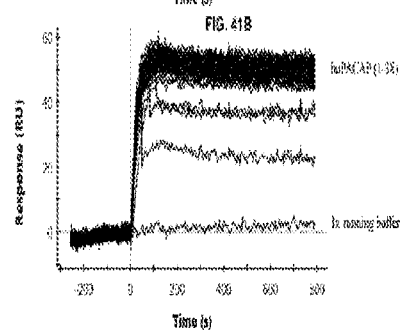

FIG. 41B presents results of surface plasmon resonance-based binding kinetics measurements for binding of anti-PACAP antibody Ab6 to PACAP alanine scanning mutants 1A-4A, 7A, 8A, 11A, 15A, 16A, and 18V-38A, along with controls including wild-type PACAP (labelled huPACAP (1-38)) (positive control) and 1× running buffer (negative control) obtained following the protocol in Example 12 infra.

Figure 42A:
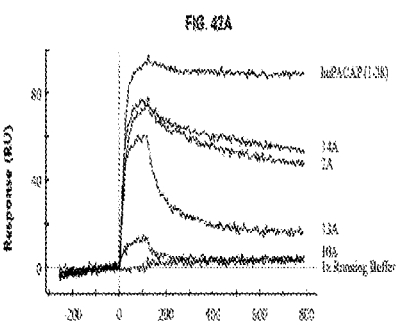

FIG. 42A presents results of surface plasmon resonance-based binding kinetics measurements for binding of anti-PACAP antibody Ab8 to PACAP alanine scanning mutants 7A, 10A, 13A, and 14A, along with controls including wild-type PACAP (labelled huPACAP (1-38)) (positive control) and 1× running buffer (negative control) obtained following the protocol in Example 12 infra.

Figure 42B:
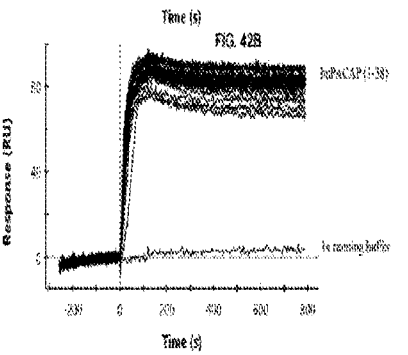

FIG. 42B presents results of surface plasmon resonance-based binding kinetics measurements for binding of anti-PACAP antibody Ab8 to PACAP alanine scanning mutants 1A-6A, 8A, 9A, 11A, 12A, and 15A-38A, along with controls including wild-type PACAP (labelled huPACAP (1-38)) (positive control) and 1× running buffer (negative control) obtained following the protocol in Example 12 infra.

FIG. 43A presents results of surface plasmon resonance-based binding kinetics measurements for binding of anti-PACAP antibody Ab9 to PACAP alanine scanning mutants 7A, 10A, 12A, 13A, 14A, and 17A, along with controls including wild-type PACAP (labelled huPACAP (1-38)) (positive control) and 1× running buffer (negative control) obtained following the protocol in Example 12 infra.

FIG. 43B presents results of surface plasmon resonance-based binding kinetics measurements for binding of anti-PACAP antibody Ab9 to PACAP alanine scanning mutants 1A-6A, 8A, 9A, 11A, 15A, 16A, and 18V-38A, along with controls including wild-type PACAP (labelled huPACAP (1-38)) (positive control) and 1× running buffer (negative control) obtained following the protocol in Example 12 infra.

FIG. 44A presents results of surface plasmon resonance-based binding kinetics measurements for binding of anti-PACAP antibody Ab22 to PACAP alanine scanning mutants 22A, 23A, 27A, 28A, and 31A, along with controls including wild-type PACAP (labelled huPACAP (1-38)) (positive control) and 1× running buffer (negative control) obtained following the protocol in Example 12 infra.

FIG. 44B presents results of surface plasmon resonance-based binding kinetics measurements for binding of anti-PACAP antibody Ab22 to PACAP alanine scanning mutants 1A-21A, 24V-26A, 29A, and 30A, along with controls including wild-type PACAP (labelled huPACAP (1-38)) (positive control) and 1× running buffer (negative control) obtained following the protocol in Example 12 infra.

FIG. 45A presents results of surface plasmon resonance-based binding kinetics measurements for binding of anti-PACAP antibody Ab23 to PACAP alanine scanning mutants 12A, 20A, 23A, 24V, 26A, 27A, and 28A, along with controls including wild-type PACAP (labelled huPACAP (1-38)) (positive control) and 1× running buffer (negative control) obtained following the protocol in Example 12 infra.

FIG. 45B presents results of surface plasmon resonance-based binding kinetics measurements for binding of anti-PACAP antibody Ab23 to PACAP alanine scanning mutants 1A-11A, 13A-19A, 21A, 22A, 25V, and 29A-31A, along with controls including wild-type PACAP (labelled huPACAP (1-38)) (positive control) and 1× running buffer (negative control) obtained following the protocol in Example 12 infra.

FIG. 46A presents a summary of the effects of PACAP alanine scanning mutants on antibody binding. In column 1 of FIG. 46A, VIP residues are listed in the order of their spatial arrangement along the VIP primary sequence from amino acid residues 1-27. In column 2 of FIG. 46A, PACAP residues are listed in the order of their spatial arrangement along the PACAP primary sequence from amino acid residues 1-27. Column 3 of FIG. 46A provides the number corresponding to each residue from 1-27 for both VIP and PACAP, as arranged spatially along their primary polypeptide sequences. In columns 4-12 of FIG. 46A, the antibodies Ab1, Ab2, Ab13, Ab14, Ab15, Ab16, Ab17, Ab18, and Ab19 tested during the alanine scanning studies, and the PACAP residues determined to contribute to PACAP/antibody binding (such as 5A, 6A, for example), are listed.

FIG. 46B presents a summary of the effects of PACAP alanine scanning mutants on antibody binding. In column 1 of FIG. 46B, VIP residue 28 is listed. In column 2 of FIG. 46B, PACAP residues are listed in the order of their spatial arrangement along the PACAP primary sequence from amino acid residues 28-38. Column 3 of FIG. 46B provides the number corresponding to residue 28 for VIP and each of residues 28-38 for PACAP, as arranged spatially along their primary polypeptide sequences. In columns 4-12 of FIG. 46B, the antibodies Ab1, Ab2, Ab13, Ab14, Ab15, Ab16, Ab17, Ab18, and Ab19 tested during the alanine scanning studies, and the PACAP residues determined to contribute to PACAP/antibody binding (such as 5A, 6A, for example), are listed.

FIG. 47A presents a summary of the effects of PACAP alanine scanning mutants on antibody binding. In column 1 of FIG. 47A, VIP residues are listed in the order of their spatial arrangement along the VIP primary sequence from amino acid residues 1-27. In column 2 of 47A, PACAP residues are listed in the order of their spatial arrangement along the PACAP primary sequence from amino acid residues 1-27. Column 3 of FIG. 47A provides the number corresponding to each residue from 1-27 for both VIP and PACAP, as arranged spatially along their primary polypeptide sequences. In columns 4-12 of FIG. 47A, the antibodies Ab5, Ab7, Ab11, Ab12, Ab4, Ab3, Ab6, Ab8, Ab9, Ab22, and Ab23 tested during the alanine scanning studies, and the PACAP residues determined to contribute to PACAP/antibody binding (such as 5A, 6A, for example), are listed.

FIG. 47B presents a summary of the effects of PACAP alanine scanning mutants on antibody binding. In column 1 of FIG. 47B, VIP residue 28 is listed. In column 2 of FIG. 47B, PACAP residues are listed in the order of their spatial arrangement along the PACAP primary sequence from amino acid residues 28-38. Column 3 of FIG. 47B provides the number corresponding to residue 28 for VIP and for each of 28-38 for PACAP, as arranged spatially along their primary polypeptide sequences. In columns 4-12 of FIG. 47B, the antibodies Ab5, Ab7, Ab11, Ab12, Ab4, Ab3, Ab6, Ab8, Ab9, Ab22, and Ab23 tested during the alanine scanning studies, and the PACAP residues determined to contribute to PACAP/antibody binding (such as 5A, 6A, for example), are listed.

DETAILED DESCRIPTION

Definitions

It is to be understood that this invention is not limited to the particular methodology, protocols, cell lines, animal species or genera, and reagents described, as such may vary. It is also to be understood that the terminology used herein is for the purpose of describing particular embodiments only, and is not intended to limit the scope of the present invention, which will be limited only by the appended claims. As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this invention belongs unless clearly indicated otherwise.

Pituitary Adenylate Cyclase Activating Polypeptide (PACAP): As used herein, unless stated otherwise PACAP includes any mammalian form of PACAP, and in particular encompasses the following *Homo sapiens* PACAP27 and *Homo sapiens* PACAP38 amino acid sequences:

PACAP38:

HSDGIFTDSYSRYRKQMAVKKYLAAVLG-KRYKQRVKNK (SEQ ID NO: 1241), wherein the C-terminal lysine is amidated; but also any mutants, splice variants, isoforms, orthologs, homologs, and variants of this sequence.

PACAP27:

HSDGIFTDSYSRYRKQMAVKKYLAAVL (SEQ ID NO: 1242), wherein the C-terminal leucine is amidated; but also any mutants, splice variants, isoforms, orthologs, homologs, and variants of this sequence.

"Photophobia" herein refers to a symptom of abnormal intolerance to visual perception of light, sometimes additionally defined by abnormal or irrational fear of light, or by presence of actual physical photosensitivity of the eyes. In the present invention photophobia includes in particular light aversion associated with migraine, cluster headaches and other neurological causes of light aversive behavior that can trigger a migraine or cluster headache. Patients/subjects can develop photophobia as a result of several different medical conditions, related to the eye or the nervous system. Photophobia can be caused by an increased response to light starting at any step in the visual system such as: (i) too much light entering the eye, (ii) too much light can enter the eye if it is damaged, such as with corneal abrasion and retinal damage, or if a pupil(s) is unable to normally constrict (seen with damage to the oculomotor nerve), (iii) overstimulation of the photoreceptors in the retina, (iv) excessive electric impulses to the optic nerve, and (v) excessive response in the central nervous system.

"Effective treatment or prevention of photophobia" herein refers to inhibiting light aversive behavior or photophobia or inhibiting the onset of light aversive behavior or photophobia in a subject in need thereof, e.g., a subject having an active migraine attack or cluster headache or a subject prone to migraine or cluster headaches, or one of the other photophobia-associated disorders identified herein after administration of an effective amount of an anti-PACAP antibody or antigen binding fragment thereof according to the invention. The treatment may be effected as a monotherapy or in association with another active agent such as topiramate or dihydroergotamine by way of example.

The term "migraine" refers to a complex and disabling neurological disorder that may progress during four stages: prodrome, aura, headache, and postdrome. A migraine is defined by the International Headache Society as a headache that lasts for 4-72 hours and is characterized by at least two of the following: unilateral localization, pulsating quality, moderate to severe pain intensity; and aggravation by movement such as walking. In addition, the headache must be accompanied by at least one of the following: nausea and/or vomiting, photophobia, or phonophobia. A migraine may also be accompanied by aura, which typically precedes the deadline during the premonition or prodrome phase, and often results in visual changes, e.g., a scintillating scotoma that moves across the visual field. The prodrome may also be accompanied by other symptoms, e.g., fatigue, gastrointestinal issues, and mood changes. A migraineur is often incapacitated for extended periods of time. The postdrome is the final phase and occurs after the attack, during which time the migraineur may feel exhausted or mildly euphoric.

The term "headache" refers to pain in any region of the head. Headaches may occur on one or both sides of the head, be isolated to a certain location, radiate across the head from one point, or have a vise-like quality. A headache may be a sharp pain, throbbing sensation or dull ache. Headaches may appear gradually or suddenly, and they may last less than an hour or for several days.

The term "pain associated disease or condition" refers to any disease or condition defined, in whole or in part, by acute and/or chronic pain. Pain is generally defined as an unpleasant sensory and emotional experience associated with actual or potential tissue damage, or described in terms of such damage. Pain may be classified as neurogenic, neuropathic, inflammatory, or nociceptic.

The term "opioid analgesic" herein refers to all drugs, natural or synthetic, with morphine-like actions. The synthetic and semi-synthetic opioid analgesics are derivatives of five chemical classes of compound: phenanthrenes; phenylheptylamines; phenylpiperidines; morphinans; and benzomorphans, all of which are within the scope of the term. Exemplary opioid analgesics include codeine, dihydrocodeine, diacetylmorphine, hydrocodone, hydromorphone, levorphanol, oxymorphone, alfentanil, buprenorphine, butorphanol, fentanyl, sufentanil, meperidine, methadone, nalbuphine, propoxyphene, and pentazocine, or pharmaceutically acceptable salts thereof.

The term "NSAID" refers to a non-steroidal anti-inflammatory compound. NSAIDs are categorized by virtue of their ability to inhibit cyclooxygenase. Cyclooxygenase 1 and cyclooxygenase 2 are two major isoforms of cyclooxygenase and most standard NSAIDs are mixed inhibitors of the two isoforms. Most standard NSAIDs fall within one of the following five structural categories: (1) propionic acid derivatives, such as ibuprofen, naproxen, naprosyn, diclofenac, and ketoprofen; (2) acetic acid derivatives, such as tolmetin and sulindac; (3) fenamic acid derivatives, such as mefenamic acid and meclofenamic acid; (4) biphenylcarboxylic acid derivatives, such as diflunisal and flufenisal;

and (5) oxicams, such as piroxim, sudoxicam, and isoxicam. Another class of NSAID has been described that selectively inhibit cyclooxygenase 2. COX-2 inhibitors have been described, e.g., in U.S. Pat. Nos. 5,616,601; 5,604,260; 5,593,994; 5,550,142; 5,536,752; 5,521,213; 5,475,995; 5,639,780; 5,604,253; 5,552,422; 5,510,368; 5,436,265; 5,409,944; and 5,130,311, all of which are hereby incorporated by reference. Certain exemplary COX-2 inhibitors include celecoxib (SC-58635), DUP-697, flosulide (CGP-28238), meloxicam, 6-methoxy-2 naphthylacetic acid (6-MNA), rofecoxib, MK-966, nabumetone (prodrug for 6-MNA), nimesulide, NS-398, SC-5766, SC-58215, T-614; or combinations thereof.

As used herein, "treatment" is an approach for obtaining beneficial or desired clinical results. For purposes of this invention, beneficial or desired clinical results include, but are not limited to, one or more of the following: improvement in any aspect of PACAP-related conditions such as migraine or headache. For example in the context of headache or migraine treatment this includes lessening severity, alleviation of pain intensity, and other associated symptoms, reducing frequency of recurrence, increasing the quality of life of those suffering from the headache, and decreasing dose of other medications required to treat the headache. For migraine, other associated symptoms include, but are not limited to, nausea, vomiting, and sensitivity to light, sound, and/or movement. For cluster headache, other associated symptoms include, but are not limited to swelling under or around the eyes, excessive tears, red eye, rhinorrhea or nasal congestion, and red flushed face.

"Reducing incidence" or "prophylaxis" or "prevention" means any of reducing severity for a particular disease, condition, symptom, or disorder (the terms disease, condition, and disorder are used interchangeably throughout the application). Reduction in severity includes reducing drugs and/or therapies generally used for the condition by, for example, reducing the need for, amount of, and/or exposure to drugs or therapies. Reduction in severity also includes reducing the duration, and/or frequency of the particular condition, symptom, or disorder (including, for example, delaying or increasing time to next episodic attack in an individual).

"Ameliorating" headache or one or more symptoms of headache or migraine or other PACAP-related condition means a lessening or improvement of one or more symptoms of the condition, e.g., headache or migraine as compared to not administering an anti-PACAP antagonist antibody. "Ameliorating" also includes shortening or reduction in duration of a symptom.

As used herein, "controlling headache" or "controlling migraine" or "controlling" another PACAP-related condition refers to maintaining or reducing severity or duration of one or more symptoms of the condition, e.g., headache or migraine or frequency of headache or migraine attacks in an individual (as compared to the level before treatment). For example, the duration or severity of head pain, or frequency of attacks is reduced by at least about any of 10%, 20%, 30%, 40%, 50%, 60%, 70%, 80%, 90%, or 100% in the individual as compared to the level before treatment. The reduction in the duration or severity of head pain, or frequency of attacks can last for any length of time, e.g., 2 weeks, 4 weeks (1 month), 8 weeks (2 months), 16 weeks (3 months), 4 months, 5 months, 6 months, 9 months, 12 months, etc.

As used therein, "delaying" the development of a PACAP-related condition such as migraine or headache means to defer, hinder, slow, retard, stabilize, and/or postpone progression of the condition or disease. This delay can be of varying lengths of time, depending on the history of the condition or disease and/or individuals being treated. As is evident to one skilled in the art, a sufficient or significant delay can, in effect, encompass prevention, in that the individual does not develop headache (e.g., migraine). A method that "delays" development of the symptom is a method that reduces probability of developing the symptom in a given time frame and/or reduces extent of the symptoms in a given time frame, when compared to not using the method. Such comparisons are typically based on clinical studies, using a statistically significant number of subjects.

"Development" or "progression" of a PACAP-related condition such as migraine or headache means initial manifestations and/or ensuing progression of the disorder. Development of headache or migraine can be detectable and assessed using standard clinical techniques as well known in the art. However, development also refers to progression that may be undetectable. For purpose of this invention, development, or progression refers to the biological course of the symptoms. "Development" includes occurrence, recurrence, and onset. As used herein "onset" or "occurrence" of a condition such as headache or migraine includes initial onset and/or recurrence.

As used herein, an "effective dosage" or "effective amount" of drug, compound, or pharmaceutical composition is an amount sufficient to effect beneficial or desired results. For prophylactic use, beneficial or desired results include results such as eliminating or reducing the risk, lessening the severity, or delaying the outset of the disease, including biochemical, histological, and/or behavioral symptoms of the disease, its complications and intermediate pathological phenotypes presenting during development of the disease. For therapeutic use, beneficial or desired results include clinical results such as reducing pain intensity, duration, or frequency of headache attack, and decreasing one or more symptoms resulting from headache (biochemical, histological, and/or behavioral), including its complications and intermediate pathological phenotypes presenting during development of the disease, increasing the quality of life of those suffering from the disease, decreasing the dose of other medications required to treat the disease, enhancing effect of another medication, and/or delaying the progression of the disease of patients. An effective dosage can be administered in one or more administrations. For purposes of this invention, an effective dosage of drug, compound, or pharmaceutical composition is an amount sufficient to accomplish prophylactic or therapeutic treatment either directly or indirectly. As is understood in the clinical context, an effective dosage of a drug, compound, or pharmaceutical composition may or may not be achieved in conjunction with another drug, compound, or pharmaceutical composition. Thus, an "effective dosage" may be considered in the context of administering one or more therapeutic agents, and a single agent may be considered to be given in an effective amount if, in conjunction with one or more other agents, a desirable result may be or is achieved.

A "suitable host cell" or "host cell" generally includes any cell wherein the subject anti-PACAP antibodies and antigen binding fragments thereof can be produced recombinantly using techniques and materials readily available. For example, the anti-PACAP antibodies and antigen binding fragments thereof of the present invention can be produced in genetically engineered host cells according to conventional techniques. Suitable host cells are those cell types that can be transformed or transfected with exogenous DNA and grown in culture, and include bacteria, fungal cells (e.g., yeast), and cultured higher eukaryotic cells (including cultured cells of multicellular organisms), particularly cultured mammalian cells, e.g., human or non-human mammalian cells. In an exemplary embodiment these antibodies may be expressed in CHO cells. Techniques for manipulating cloned DNA molecules and introducing exogenous DNA into a variety of host cells are disclosed by Sambrook et al., *Molecular Cloning: A Laboratory Manual,* 2nd ed., Cold Spring Harbor, N.Y.: Cold Spring Harbor Laboratory Press (1989), and *Current Protocols in Molecular Biology,* Ausubel et al., editors, New York, N.Y.: Green and Wiley and Sons (1993).

In some exemplary embodiments the antibodies may be expressed in mating competent yeast, e.g., any haploid, diploid or tetraploid yeast that can be grown in culture. Yeast useful in fermentation expression methods may exist in a haploid, diploid, or other polyploid form. The cells of a given ploidy may, under appropriate conditions, proliferate for an indefinite number of generations in that form. Diploid cells can also sporulate to form haploid cells. Sequential mating can result in tetraploid strains through further mating or fusion of diploid strains. The present invention contemplates the use of haploid yeast, as well as diploid or other polyploid yeast cells produced, for example, by mating or spheroplast fusion. By way of example, such yeast may include members of the Saccharomycetaceae family, which includes the genera *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis;* and *Zygosaccharomyces.* Other types of yeast potentially useful in the invention include *Yarrowia; Rhodosporidium; Candida; Hansenula; Filobasium; Sporidiobolus; Bullera; Leucosporidium* and *Filobasidella.*

In a preferred exemplary embodiment of the invention, the mating competent yeast used for antibody expression may comprise a member of the genus *Pichia*. In a further preferred exemplary embodiment of the invention, the mating competent yeast of the genus *Pichia* is one of the following species: *Pichia pastoris, Pichia methanolica,* and *Hansenula polymorpha (Pichia angusta)*. In a particularly preferred embodiment of the invention, the mating competent yeast of the genus *Pichia* is the species *Pichia pastoris*.

A "selectable marker" herein refers to a gene or gene fragment that confers a growth phenotype (physical growth characteristic) on a cell receiving that gene as, for example through a transformation event. The selectable marker allows that cell to survive and grow in a selective growth medium under conditions in which cells that do not receive that selectable marker gene cannot grow. Selectable marker genes generally fall into several types, including positive selectable marker genes such as a gene that confers on a cell resistance to an antibiotic or other drug, temperature when two temperature sensitive ("ts") mutants are crossed or a is mutant is transformed; negative selectable marker genes such as a biosynthetic gene that confers on a cell the ability to grow in a medium without a specific nutrient needed by all cells that do not have that biosynthetic gene, or a mutagenized biosynthetic gene that confers on a cell inability to grow by cells that do not have the wild type gene; and the like. Suitable markers include but are not limited to: ZEO; G418; LYS3; MET1; MET3a; ADE1; ADE3; URA3; and the like.

An "expression vector" herein refers to DNA vectors containing elements that facilitate manipulation for the expression of a foreign protein within the target host cell, e.g., a bacterial, insect, yeast, plant, amphibian, reptile, avian, or mammalian cell, and most typically a yeast or mammalian cell, e.g., a CHO cell. Conveniently, manipulation of sequences and production of DNA for transformation is first performed in a bacterial host, e.g. *E. coli*, and usually vectors will include sequences to facilitate such manipulations, including a bacterial origin of replication and appropriate bacterial selection marker. Selection markers encode proteins necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, (b) complement auxotrophic deficiencies, or (c) supply critical nutrients not available from complex media. Exemplary vectors and methods for transformation of yeast are described, for example, in Burke, D., Dawson, D., & Stearns, T., *Methods in yeast genetics: a Cold Spring Harbor Laboratory course manual,* Plainview, N.Y.: Cold Spring Harbor Laboratory Press (2000). Expression vectors for use in the methods of the invention may include yeast or mammalian specific sequences, including a selectable auxotrophic or drug marker for identifying transformed host strains. A drug marker may further be used to amplify copy number of the vector in a yeast host cell.

The polypeptide coding sequence of interest is operably linked to transcriptional and translational regulatory sequences that provide for expression of the polypeptide in the desired host cells, e.g., yeast or mammalian cells. These vector components may include, but are not limited to, one or more of the following: an enhancer element, a promoter, and a transcription termination sequence. Sequences for the secretion of the polypeptide may also be included, e.g. a signal sequence, and the like. An origin of replication, e.g., a yeast origin of replication, is optional, as expression vectors are often integrated into the host cell genome. In one embodiment of the invention, the polypeptide of interest is operably linked, or fused, to sequences providing for optimized secretion of the polypeptide from yeast diploid cells.

Nucleic acids are "operably linked" when placed into a functional relationship with another nucleic acid sequence. For example, DNA for a signal sequence is operably linked to DNA for a polypeptide if it is expressed as a preprotein that participates in the secretion of the polypeptide; a promoter or enhancer is operably linked to a coding sequence if it affects the transcription of the sequence. Generally, "operably linked" means that the DNA sequences being linked are contiguous, and, in the case of a secretory leader, contiguous and in reading frame. However, enhancers do not have to be contiguous. Linking is accomplished by ligation at convenient restriction sites or alternatively via a PCR/recombination method familiar to those skilled in the art (GATEWAY® Technology; Invitrogen, Carlsbad Calif.). If such sites do not exist, the synthetic oligonucleotide adapters or linkers are used in accordance with conventional practice.

Promoters are untranslated sequences located upstream (5') to the start codon of a structural gene (generally within about 100 to 1000 bp) that control the transcription and translation of particular nucleic acid sequences to which they are operably linked. Such promoters fall into several classes: inducible, constitutive, and repressible promoters (that increase levels of transcription in response to absence of a repressor). Inducible promoters may initiate increased levels of transcription from DNA under their control in response to some change in culture conditions, e.g., the presence or absence of a nutrient or a change in temperature.

The promoter fragment may also serve as the site for homologous recombination and integration of the expression vector into the same site in the host cell, e.g., yeast cell, genome; alternatively, a selectable marker may be used as the site for homologous recombination. Pichia transformation is described in Cregg et al., *Mol. Cell. Biol.*, 5:3376-3385 (1985). Suitable promoters for use in different eukaryotic and prokaryotic cells are well known and commercially available.

The polypeptides of interest may be produced recombinantly not only directly, but also as a fusion polypeptide with a heterologous polypeptide, e.g. a signal sequence or other polypeptide having a specific cleavage site at the N-terminus of the mature protein or polypeptide. In general, the signal sequence may be a component of the vector, or it may be a part of the polypeptide coding sequence that is inserted into the vector. The heterologous signal sequence selected preferably is one that is recognized and processed through one of the standard pathways available within the host cell, e.g., a mammalian cell, an insect cell, or a yeast cell. Additionally, these signal peptide sequences may be engineered to provide for enhanced secretion in expression systems. Secretion signals of interest also include mammalian and yeast signal sequences, which may be heterologous to the protein being secreted, or may be a native sequence for the protein being secreted. Signal sequences include pre-peptide sequences, and in some instances may include propeptide sequences. Many such signal sequences are known in the art, including the signal sequences found on immunoglobulin chains, e.g., K28 preprotoxin sequence, PHA-E, FACE, human MCP-1, human serum albumin signal sequences, human Ig heavy chain, human Ig light chain, and the like. For example, see Hashimoto et. al., *Protein Eng.*, 11(2):75 (1998); and Kobayashi et. al., *Therapeutic Apheresis*, 2(4): 257 (1998)).

Transcription may be increased by inserting a transcriptional activator sequence into the vector. These activators are cis-acting elements of DNA, usually about from 10 to 300 bp, which act on a promoter to increase its transcription. Transcriptional enhancers are relatively orientation and position independent, having been found 5' and 3' to the transcription unit, within an intron, as well as within the coding sequence itself. The enhancer may be spliced into the expression vector at a position 5' or 3' to the coding sequence, but is preferably located at a site 5' from the promoter.

Expression vectors used in eukaryotic host cells may also contain sequences necessary for the termination of transcription and for stabilizing the mRNA. Such sequences are commonly available from 3' to the translation termination codon, in untranslated regions of eukaryotic or viral DNAs or cDNAs. These regions contain nucleotide segments transcribed as polyadenylated fragments in the untranslated portion of the mRNA.

Construction of suitable vectors containing one or more of the above-listed components employs standard ligation techniques or PCR/recombination methods. Isolated plasmids or DNA fragments are cleaved, tailored, and re-ligated in the form desired to generate the plasmids required or via recombination methods. For analysis to confirm correct sequences in plasmids constructed, the ligation mixtures are used to transform host cells, and successful transformants selected by antibiotic resistance (e.g. ampicillin or Zeocin) where appropriate. Plasmids from the transformants are prepared, analyzed by restriction endonuclease digestion, and/or sequenced.

As an alternative to restriction and ligation of fragments, recombination methods based on specific attachment ("att") sites and recombination enzymes may be used to insert DNA sequences into a vector. Such methods are described, for example, by Landy, *Ann. Rev. Biochem.*, 58:913-949 (1989); and are known to those of skill in the art. Such methods utilize intermolecular DNA recombination that is mediated by a mixture of lambda and *E. coli*—encoded recombination proteins. Recombination occurs between att sites on the interacting DNA molecules. For a description of att sites see Weisberg and Landy, *Site-Specific Recombination in Phage Lambda*, in *Lambda II*, p. 211-250, Cold Spring Harbor, N.Y.: Cold Spring Harbor Press (1983). The DNA segments flanking the recombination sites are switched, such that after recombination, the att sites are hybrid sequences comprised of sequences donated by each parental vector. The recombination can occur between DNAs of any topology.

Att sites may be introduced into a sequence of interest by ligating the sequence of interest into an appropriate vector; generating a PCR product containing att B sites through the use of specific primers; generating a cDNA library cloned into an appropriate vector containing att sites; and the like.

Folding, as used herein, refers to the three-dimensional structure of polypeptides and proteins, where interactions between amino acid residues act to stabilize the structure. While non-covalent interactions are important in determining structure, usually the proteins of interest will have intra- and/or intermolecular covalent disulfide bonds formed by two cysteine residues. For naturally occurring proteins and polypeptides or derivatives and variants thereof, the proper folding is typically the arrangement that results in optimal biological activity, and can conveniently be monitored by assays for activity, e.g. ligand binding, enzymatic activity, etc.

In some instances, for example where the desired product is of synthetic origin, assays based on biological activity will be less meaningful. The proper folding of such molecules may be determined on the basis of physical properties, energetic considerations, modeling studies, and the like.

The expression host may be further modified by the introduction of sequences encoding one or more enzymes that enhance folding and disulfide bond formation, i.e. foldases, chaperonins, etc. Such sequences may be constitutively or inducibly expressed in the yeast host cell, using vectors, markers, etc. as known in the art. Preferably the sequences, including transcriptional regulatory elements sufficient for the desired pattern of expression, are stably integrated in the yeast genome through a targeted methodology.

For example, the eukaryotic protein disulfide isomerase ("PDI") is not only an efficient catalyst of protein cysteine oxidation and disulfide bond isomerization, but also exhibits chaperone activity. Co-expression of PDI can facilitate the production of active proteins having multiple disulfide bonds. Also of interest is the expression of immunoglobulin heavy chain binding protein ("BIP"); cyclophilin; and the like. In one embodiment of the invention, each of the haploid parental strains expresses a distinct folding enzyme, e.g. one strain may express BIP, and the other strain may express PDI or combinations thereof.

Cultured mammalian cells are also preferred exemplary hosts for production of the disclosed anti-PACAP antibodies and antigen binding fragments thereof. As mentioned CHO cells are particularly suitable for expression of antibodies. Many procedures are known in the art for manufacturing monoclonal antibodies in mammalian cells. (See, Galfre, G. and Milstein, C., *Methods Enzym.*, 73:3-46, 1981; Basalp et al., *Turk. J. Biol.*, 24:189-196, 2000; Wurm, F. M., *Nat. Biotechnol.*, 22:1393-1398, 2004; and Li et al., *mAbs*, 2(5): 466-477, 2010). As mentioned in further detail infra, common host cell lines employed in mammalian monoclonal antibody manufacturing schemes include, but are not limited to, human embryonic retinoblast cell line PER.C6® (Crucell N.V., Leiden, The Netherlands), NS0 murine myeloma cells (Medical Research Council, London, UK), CV1 monkey kidney cell line, 293 human embryonic kidney cell line, BHK baby hamster kidney cell line, VERO African green monkey kidney cell line, human cervical carcinoma cell line HELA, MDCK canine kidney cells, BRL buffalo rat liver cells, W138 human lung cells, HepG2 human liver cells, MMT mouse mammary tumor cells, TRI cells, MRC5 cells, Fs4 cells, myeloma or lymphoma cells, or Chinese Hamster (*Cricetulus griseus*) Ovary (CHO) cells, and the like. Many different subclones or sub-cell lines of CHO cells known in the art that are useful and optimized for production of recombinant monoclonal antibodies, such as the DP12 (CHO K1 dhfr−) cell line, NS0 cells are a non-Ig secreting, non-light chain-synthesizing subclone of NS-1 cells that are resistant to azaguanine. Other Chinese Hamster and CHO cells are commercially available (from ATCC, etc.), including CHO-DXB11 (CHO-DUKX), CHO-pro3, CHO-DG44, CHO 1-15, CHO DP-12, Lec2, M1WT3, Lec8, pgsA-745, and the like, all of which are genetically altered to optimize the cell line for various parameters. Monoclonal antibodies are commonly manufactured using a batch fed method whereby the monoclonal antibody chains are expressed in a mammalian cell line and secreted into the tissue culture medium in a bioreactor. Medium (or feed) is continuously supplied to the bioreactor to maximize recombinant protein expression. Recombinant monoclonal antibody is then purified from the collected media. In some circumstances, additional steps are needed to reassemble the antibodies through reduction of disulfide bonds, etc. Such production methods can be scaled to be as large as 10,000 L in a single batch or more. It is now routine to obtain as much as 20 pg/cell/day through the use of such cell lines and methodologies, providing titers as high as 10 g/L or more, amounting to 15 to 100 kg from bioreactors of 10 kL to 25 kL. (Li et al., 2010). Various details of this production methodology, including cloning of the polynucleotides encoding the antibodies into expression vectors, transfecting cells with these expression vectors, selecting for transfected cells, and expressing and purifying the recombinant monoclonal antibodies from these cells are provided below.

For recombinant production of an anti-PACAP antibody or antigen binding fragment in mammalian cells, nucleic acids encoding the antibody or fragment thereof are generally inserted into a replicable vector for further cloning (amplification of the DNA) or for expression. DNA encoding the antibody is readily isolated or synthesized using conventional procedures (e.g., by using oligonucleotide probes that are capable of binding specifically to DNAs encoding the heavy and light chains of the antibody). The vector components generally include, but are not limited to, one or more of the following: a signal sequence, an origin of replication, one or more marker genes, an enhancer element, a promoter, and a transcription termination sequence. Selection of promoters, terminators, selectable markers, vectors, and other elements is a matter of routine design within the level of ordinary skill in the art. Many such elements are known in the art and are available through commercial suppliers.

The antibodies of this invention may be produced recombinantly not only directly, but also as a fusion polypeptide with a heterologous polypeptide, which is preferably a signal sequence or other polypeptide having a specific cleavage site at the N-terminus of the mature protein or polypeptide. The homologous or heterologous signal sequence selected preferably is one that is recognized and processed (i.e., cleaved by a signal peptidase) by the host cell. In mammalian cell expression, mammalian signal sequences as well as viral secretory leaders, for example, the herpes simplex gD signal, are available.

Such expression vectors and cloning vectors will generally contain a nucleic acid sequence that enables the vector to replicate in one or more selected host cells. Typically, in cloning vectors this sequence is one that enables the vector to replicate independently of the host chromosomal DNA, and includes origins of replication or autonomously replicating sequences. Such sequences are well known for a variety of bacteria, yeast, and viruses, e.g., the origin of replication from the plasmid pBR322 is suitable for most Gram-negative bacteria, the 2 mu plasmid origin is suitable for yeast, and various viral origins (Simian Virus 40 ("SV40"), polyoma, adenovirus, vesicular stomatitis virus ("VSV"), or bovine papillomavirus ("BPV") are useful for cloning vectors in mammalian cells. Generally, the origin of replication component is not needed for mammalian expression vectors (the SV40 origin may typically be used only because it contains the early promoter).

These vectors will also typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

One example of a selection scheme utilizes a drug to arrest growth of a host cell. Drug selection is generally used to select for cultured mammalian cells into which foreign DNA has been inserted. Such cells are commonly referred to as "transfectants". Cells that have been cultured in the presence of the selective agent and are able to pass the gene of interest to their progeny are referred to as "stable transfectants." Examples of such dominant selection use the drugs neomycin, mycophenolic acid, and hygromycin. An exemplary selectable marker is a gene encoding resistance to the antibiotic neomycin. Selection is carried out in the presence of a neomycin-type drug, such as G-418 or the like. Those cells that are successfully transformed with a heterologous gene produce a protein conferring drug resistance and thus survive the selection regimen.

Selection systems can also be used to increase the expression level of the gene of interest, a process referred to as "amplification." Amplification of transfectants typically occurs by culturing the cells in the presence of a low level of the selective agent and then increasing the amount of selective agent to select for cells that produce high levels of the products of the introduced genes. Exemplary suitable selectable markers for mammalian cells are those that enable the identification of cells competent to take up the antibody nucleic acid, such as dihydrofolate reductase ("DHFR"), thymidine kinase, metallothionein-I and -II, preferably primate metallothionein genes, adenosine deaminase, ornithine decarboxylase, etc.

For example, an amplifiable selectable marker for mammalian cells is dihydrofolate reductase, which confers resistance to methotrexate. Other drug resistance genes (e.g. hygromycin resistance, multi-drug resistance, puromycin acetyltransferase) can also be used. Cells transformed with the DHFR selection gene are first identified by culturing all of the transformants in a culture medium that contains methotrexate ("MTX"), a competitive antagonist of DHFR. An appropriate host cell when wild-type DHFR is employed is the Chinese hamster ovary ("CHO") cell line deficient in DHFR activity.

Alternatively, host cells (particularly wild-type hosts that contain endogenous DHFR) transformed or co-transformed with DNA sequences encoding antibody, wild-type DHFR protein, and another selectable marker such as aminoglycoside 3'-phosphotransferase ("APH") can be selected by cell growth in medium containing a selection agent for the selectable marker such as an aminoglycosidic antibiotic, e.g., kanamycin, neomycin, or G-418. See U.S. Pat. No. 4,965,199.

These vectors may comprise an enhancer sequence that facilitates transcription of a DNA encoding the antibody. Many enhancer sequences are known from mammalian genes (for example, globin, elastase, albumin, alpha-fetoprotein, and insulin). A frequently used enhancer is one derived from a eukaryotic cell virus. Examples thereof include the SV40 enhancer on the late side of the replication origin (bp 100-270), the cytomegalovirus early promoter enhancer, the polyoma enhancer on the late side of the replication origin, and adenovirus enhancers (See also Yaniv, *Nature,* 297:17-18 (1982) on enhancing elements for activation of eukaryotic promoters). The enhancer may be spliced into the vector at a position 5' or 3' to the antibody-encoding sequence, but is preferably located at a site 5' from the promoter.

Expression and cloning vectors will also generally comprise a promoter that is recognized by the host organism and is operably linked to the antibody nucleic acid. Promoter sequences are known for eukaryotes. Virtually all eukaryotic genes have an AT-rich region located approximately 25 to 30 bases upstream from the site where transcription is initiated. Another sequence found 70 to 80 bases upstream from the start of transcription of many genes is a CNCAAT region where N may be any nucleotide. At the 3' end of most eukaryotic genes is an AATAAA sequence that may be the signal for addition of the poly A tail to the 3' end of the coding sequence. All of these sequences are suitably inserted into eukaryotic expression vectors.

Antibody transcription from vectors in mammalian host cells is controlled, for example, by promoters obtained from the genomes of viruses such as polyoma virus, fowlpox virus, adenovirus (such as Adenovirus 2), BPV, avian sarcoma virus, cytomegalovirus, a retrovirus, hepatitis-B virus, and most preferably SV40, from heterologous mammalian promoters, e.g., the actin promoter or an immunoglobulin promoter, from heat-shock promoters, provided such promoters are compatible with the host cell systems.

The early and late promoters of the SV40 virus are conveniently obtained as an SV40 restriction fragment that also contains the SV40 viral origin of replication. The immediate early promoter of the human cytomegalovirus is conveniently obtained as a HindIII E restriction fragment. A system for expressing DNA in mammalian hosts using the BPV as a vector is disclosed in U.S. Pat. No. 4,419,446. A modification of this system is described in U.S. Pat. No. 4,601,978. See also Reyes et al., *Nature,* 297:598-601 (1982) on expression of human beta-interferon cDNA in mouse cells under the control of a thymidine kinase promoter from herpes simplex virus. Alternatively, the rous sarcoma virus long terminal repeat can be used as the promoter.

Strong transcription promoters can be used, such as promoters from SV40, cytomegalovirus, or myeloproliferative sarcoma virus. See, e.g., U.S. Pat. No. 4,956,288 and U.S. Patent Publication No. 20030103986. Other suitable promoters include those from metallothionein genes (U.S. Pat. Nos. 4,579,821 and 4,601,978) and the adenovirus major late promoter. Expression vectors for use in mammalian cells include pZP-1, pZP-9, and pZMP21, which have been deposited with the American Type Culture Collection, 10801 University Blvd., Manassas, Va. USA under accession numbers 98669, 98668, and PTA-5266, respectively, and derivatives of these vectors.

Expression vectors used in eukaryotic host cells (yeast, fungus, insect, plant, animal, human, or a nucleated cell from other multicellular organism) will also generally contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding the antibody. One useful transcription termination component is the bovine growth hormone polyadenylation region. See WO 94/11026 and the expression vector disclosed therein.

Suitable host cells for cloning or expressing the subject antibodies include prokaryote, yeast, or higher eukaryote cells described above. However, interest has been greatest in vertebrate cells, and propagation of vertebrate cells in culture has become a routine procedure. Examples of useful mammalian host cell lines are monkey kidney CV1 line transformed by SV40 (COS-1 (ATCC No. CRL 1650); and COS-7, ATCC CRL 1651); human embryonic kidney line (293 or 293 cells subcloned for growth in suspension culture, (ATCC No. CRL 1573; Graham et al., *J. Gen. Virol.,* 36:59-72 (1977)); baby hamster kidney cells (BHK, ATCC CCL 10, ATCC No. CRL 1632; BHK 570, ATCC No. CRL 10314); CHO cells (CHO-K1, ATCC No. CCL 61; CHO-DG44, Urlaub et al., *Proc. Natl. Acad. Sci. USA,* 77:4216-4220 (1980)); mouse sertoli cells (TM4, *Mather, Biol. Reprod.,* 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., *Annals N.Y. Acad. Sci.,* 383:44-68 (1982)); MRC 5 cells; FS4 cells; and a human hepatoma line (Hep G2). Additional suitable cell lines are known in the art and available from public depositories such as the American Type Culture Collection, Manassas, Va.

Host cells are transformed with the above-described expression or cloning vectors for antibody production and cultured in conventional nutrient media modified as appropriate for inducing promoters, selecting transformants, or amplifying the genes encoding the desired sequences as discussed supra.

The mammalian host cells used to produce the antibody of this invention may be cultured in a variety of media. Commercially available media such as Ham's F10 (Sigma-Aldrich Corporation, St. Louis, Mo.), Minimal Essential Medium (("MEM" (Sigma-Aldrich Corporation, St. Louis, Mo.), Roswell Park Memorial Institute-1640 medium ("RPMI-1640", Sigma-Aldrich Corporation, St. Louis, Mo.), and Dulbecco's Modified Eagle's Medium (("DMEM" Sigma-Aldrich Corporation, St. Louis, Mo.) are suitable for culturing the host cells. In addition, any of the media described in Ham et al., *Meth. Enz.,* 58:44 (1979), Barnes et al., *Anal. Biochem.,* 102:255 (1980), U.S. Pat. No. 4,767,704; 4,657,866; 4,927,762; 4,560,655; or 5,122,469; WO 90/03430; WO 87/00195; or U.S. Pat. Reexam No. 30,985 can be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as Gentamycin drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan. Methods of development and optimization of media and culture conditions are known in the art (See, Gronemeyer et al., *Bioengineering,* 1(4):188-212, 2014).

After culture conditions are optimized and a preferred cell line clone is selected, these cells are cultured (either adherent cells or suspension cultures) most typically in a batch-fed process in a bioreactor (many models are commercially available) that involves continuously feeding the cell culture with medium and feed, optimized for the particular cell line chosen and selected for this purpose. (See, Butler, M., *Appl. Microbiol. Biotechnol.,* 68:283-291, 2005; and Kelley, B., *mAb,* 1(5):443-452, 2009). Perfusion systems are also available in which media and feed are continuously supplied to the culture while the same volume of media is being withdrawn from the bioreactor. (Wurm, 2004). Synthetic media, also commercially available, are available for growing cells in a batch-fed culture, avoiding the possibility of contamination from outside sources, such as with the use of animal components, such as bovine serum albumin, etc. However, animal-component-free hydrolysates are commercially available to help boost cell density, culture viability and productivity. (Li et al., 2010). Many studies have been performed in an effort to optimize cell culture media, including careful attention to head space available in roller bottles, redox potentials during growth and expression phases, presence of reducing agents to maintain disulfide bonds during production, etc. (See, for instance, Hutterer et al., *mAbs,* 5(4):608-613, 2013; and Mullan et al., *BMC Proceed.,* 5(Suppl 8):P110, 2011). Various methodologies have been developed to address the possibility of harmful oxidation during recombinant monoclonal antibody production. (See, for example, U.S. Pat. No. 8,574,869). Cultured cells may be grown by feeding nutrients continuously or as separately administered amounts. Often various process parameters such as cell concentration, pH, temperature, $CO_2$, $dO_2$, osmolality, amount of metabolites such as glucose, lactate, glutamine and glutamate, and the like, are monitored by the use of probes during the cell growth either on-line by direct connection to calibrated analyzers or off-line by intervention of operators. The culturing step also typically involves ensuring that the cells growing in culture maintain the transfected recombinant genes by any means known in the art for cell selection.

Following fermentation, i.e., upon reaching maximum cell growth and recombinant protein expression, the culturing step is typically followed by a harvesting step, whereby the cells are separated from the medium and a harvested cell culture media is thereby obtained. (See, Liu et al., *mAbs,* 2(5):480-499, 2010). Typically various purification steps, involving column chromatography and the like, follow culturing to separate the recombinant monoclonal antibody from cell components and cell culture media components. The exact purification steps needed for this phase of the production of recombinant monoclonal antibodies depends on the site of expression of the proteins, i.e., in the cytosol of the cells themselves, or the more commonly preferred route of protein excreted into the cell culture medium. Various cell components may be separated using techniques known in the art such as differential centrifugation techniques, gravity-based cell settling, and/or size exclusion chromatograph/filtration techniques that can include tangential flow micro-filtration or depth filtration. (See, Pollock et al., *Biotechnol. Bioeng.,* 110:206-219, 2013, and Liu et al., 2010). Centrifugation of cell components may be achieved on a large scale by use of continuous disk stack centrifuges followed by clarification using depth and membrane filters. (See, Kelley, 2009). Most often, after clarification, the recombinant protein is further purified by Protein A chromatography due to the high affinity of Protein A for the Fc domain of antibodies, and typically occurs using a low pH/acidification elution step (typically the acidification step is combined with a precautionary virus inactivation step). Flocculation and/or precipitation steps using acidic or cationic polyelectrolytes may also be employed to separate animal cells in suspension cultures from soluble proteins. (Liu et al., 2010). Lastly, anion- and cation-exchange chromatography, hydrophobic interaction chromatograph ("HIC"), hydrophobic charge induction chromatograph (HCIC), hydroxyapatite chromatography using ceramic hydroxyapatite $(Ca_5(PO_4)_3OH)_2$, and combinations of these techniques are typically used to polish the solution of recombinant monoclonal antibody. Final formulation and concentration of the desired monoclonal antibody may be achieved by use of ultracentrifugation techniques. Purification yields are typically 70 to 80%. (Kelley, 2009).

The terms "desired protein" or "desired antibody" are used interchangeably and refer generally to a parent antibody specific to a target, i.e., PACAP or a chimeric or humanized antibody or a binding portion thereof derived therefrom as described herein. The term "antibody" is intended to include any polypeptide chain-containing molecular structure with a specific shape that fits to and recognizes an epitope, where one or more non-covalent binding interactions stabilize the complex between the molecular structure and the epitope. The archetypal antibody molecule is the immunoglobulin, and all types of immunoglobulins, IgG, IgM, IgA, IgE, IgD, etc., from all sources, e.g. human, rodent, rabbit, cow, sheep, pig, dog, other mammals, chicken, other avians, etc., are considered to be "antibodies." A preferred source for producing antibodies useful as starting material according to the invention is rabbits. Examples thereof include chimeric antibodies, human antibodies and other non-human mammalian antibodies, humanized antibodies, single chain antibodies (such as scFvs), camelbodies, nanobodies, IgNAR (single-chain antibodies which may be derived from sharks, for example), small-modular immunopharmaceuticals ("SMIPs"), and antibody fragments such as Fabs, Fab', $F(ab')_2$, and the like (See Streltsov et al., *Protein Sci.,* 14(11):2901-9 (2005); Greenberg et al., *Nature,* 374(6518):168-73 (1995); Nuttall et al., *Mol. Immunol.,* 38(4):313-26 (2001); Hamers-Casterman et al., *Nature,* 363(6428):446-8 (1993); Gill et al., *Curr. Opin. Biotechnol.,* (6):653-8 (2006)).

For example, antibodies or antigen binding fragments thereof may be produced by genetic engineering. In this technique, as with other methods, antibody-producing cells are sensitized to the desired antigen or immunogen. The messenger RNA isolated from antibody producing cells is used as a template to make cDNA using PCR amplification. A library of vectors, each containing one heavy chain gene and one light chain gene retaining the initial antigen specificity, is produced by insertion of appropriate sections of the amplified immunoglobulin cDNA into the expression vectors. A combinatorial library is constructed by combining the heavy chain gene library with the light chain gene library. This results in a library of clones that co-express a heavy and light chain (resembling the Fab fragment or antigen binding fragment of an antibody molecule). The vectors that carry these genes are co-transfected into a host cell. When antibody gene synthesis is induced in the transfected host, the heavy and light chain proteins self-assemble to produce active antibodies that can be detected by screening with the antigen or immunogen.

Antibody coding sequences of interest include those encoded by native sequences, as well as nucleic acids that, by virtue of the degeneracy of the genetic code, are not identical in sequence to the disclosed nucleic acids, and variants thereof. Variant polypeptides can include amino acid ("aa") substitutions, additions, or deletions. The amino acid substitutions can be conservative amino acid substitutions or substitutions to eliminate non-essential amino acids, such as to alter a glycosylation site, or to minimize misfolding by substitution or deletion of one or more cysteine residues that are not necessary for function. Variants can be designed so as to retain or have enhanced biological activity of a particular region of the protein (e.g., a functional domain, catalytic amino acid residues, etc.). Variants also include fragments of the polypeptides disclosed herein, particularly biologically active fragments and/or fragments corresponding to functional domains. Techniques for in vitro mutagenesis of cloned genes are known. Also included in the subject invention are polypeptides that have been modified using ordinary molecular biological techniques so as to improve their resistance to proteolytic degradation or to optimize solubility properties or to render them more suitable as a therapeutic agent.

Chimeric antibodies may be made by recombinant means by combining the $V_L$ and $V_H$ regions, obtained from antibody producing cells of one species with the constant light and heavy chain regions from another. Typically chimeric antibodies utilize rodent or rabbit variable regions and human constant regions, in order to produce an antibody with predominantly human domains. The production of such chimeric antibodies is well known in the art, and may be achieved by standard means (as described, e.g., in U.S. Pat. No. 5,624,659, incorporated herein by reference in its entirety). It is further contemplated that the human constant regions of chimeric antibodies of the invention may be selected from IgG1, IgG2, IgG3, and IgG4 constant regions.

Humanized antibodies are engineered to contain even more human-like immunoglobulin domains, and incorporate only the complementarity determining regions of the animal-derived antibody. This is accomplished by carefully examining the sequence of the hyper-variable loops of the variable regions of the monoclonal antibody and fitting them to the structure of the human antibody chains. Although facially complex, the process is straightforward in practice. See, e.g., U.S. Pat. No. 6,187,287, incorporated fully herein by reference.

In addition to entire immunoglobulins (or their recombinant counterparts), immunoglobulin fragments comprising the epitope binding site (e.g., Fab', F(ab')$_2$, or other fragments) may be synthesized. "Fragment" or minimal immunoglobulins may be designed utilizing recombinant immunoglobulin techniques. For instance "Fv" immunoglobulins for use in the present invention may be produced by synthesizing a fused light chain variable region and a heavy chain variable region. Combinations of antibodies are also of interest, e.g. diabodies, which comprise two distinct Fv specificities. In another embodiment of the invention, small molecule immunopharmaceuticals ("SMIPs"), camelbodies, nanobodies, and IgNAR are encompassed by immunoglobulin fragments.

Immunoglobulins and fragments thereof may be modified post-translationally, e.g. to add effector moieties such as chemical linkers, detectable moieties, such as fluorescent dyes, enzymes, toxins, substrates, bioluminescent materials, radioactive materials, chemiluminescent moieties, and the like, or specific binding moieties, such as streptavidin, avidin, or biotin, and the like may be utilized in the methods and compositions of the present invention. Examples of additional effector molecules are provided infra.

A polynucleotide sequence "corresponds" to a polypeptide sequence if translation of the polynucleotide sequence in accordance with the genetic code yields the polypeptide sequence (i.e., the polynucleotide sequence "encodes" the polypeptide sequence), one polynucleotide sequence "corresponds" to another polynucleotide sequence if the two sequences encode the same polypeptide sequence.

A "heterologous" region or domain of a DNA construct is an identifiable segment of DNA within a larger DNA molecule that is not found in association with the larger molecule in nature. Thus, when the heterologous region encodes a mammalian gene, the DNA flanking the gene usually does not flank the mammalian genomic DNA in the genome of the source organism. Another example of a heterologous region is a construct where the coding sequence itself is not found in nature (e.g., a cDNA where the genomic coding sequence contains introns or synthetic sequences having codons different than the native gene). Allelic variations or naturally-occurring mutational events do not give rise to a heterologous region of DNA as defined herein.

A "coding sequence" is an in-frame sequence of codons that correspond to or encode a protein or peptide sequence. Two coding sequences correspond to each other if the sequences or their complementary sequences encode the same amino acid sequences. A coding sequence in association with appropriate regulatory sequences may be transcribed and translated into a polypeptide. A polyadenylation signal and transcription termination sequence will usually be located 3' to the coding sequence. A "promoter sequence" is a DNA regulatory region capable of initiating transcription of a downstream (3' direction) coding sequence, and typically contain additional sites for binding of regulatory molecules, e.g., transcription factors, that affect the transcription of the coding sequence. A coding sequence is "under the control" of the promoter sequence or "operatively linked" to the promoter when RNA polymerase binds the promoter sequence in a cell and transcribes the coding sequence into mRNA, which is then in turn translated into the protein encoded by the coding sequence.

The general structure of antibodies in vertebrates now is well understood. See Edelman, G. M., Ann. N.Y. Acad. Sci., 190:5 (1971). Antibodies consist of two identical light polypeptide chains of molecular weight approximately 23,000 daltons (the "light chain"), and two identical heavy chains of molecular weight 53,000-70,000 (the "heavy chain"). The four chains are joined by disulfide bonds in a "Y" configuration wherein the light chains bracket the heavy chains starting at the mouth of the "Y" configuration. The "branch" portion of the "Y" configuration is designated the $F_{ab}$ region; the stem portion of the "Y" configuration is designated the $F_c$ region. The amino acid sequence orientation runs from the N-terminal end at the top of the "Y" configuration to the C-terminal end at the bottom of each chain. The N-terminal end possesses the variable region having specificity for the antigen that elicited it, and is approximately 100 amino acids in length, there being slight variations between light and heavy chain and from antibody to antibody.

The variable region is linked in each chain to a constant region that extends the remaining length of the chain and that within a particular class of antibody does not vary with the specificity of the antibody (i.e., the antigen eliciting it). There are five known major classes of constant regions that determine the class of the immunoglobulin molecule (IgG, IgM, IgA, IgD, and IgE corresponding to γ, μ, α, δ, and ε (gamma, mu, alpha, delta, or epsilon) heavy chain constant regions). The constant region or class determines subsequent effector function of the antibody, including activation of complement (see Kabat, E. A., *Structural Concepts in Immunology and Immunochemistry,* 2nd Ed., p. 413-436, New York, N.Y.: Holt, Rinehart, Winston (1976)), and other cellular responses (see Andrews et al., *Clinical Immunology,* pp. 1-18, W. B. Sanders, Philadelphia, Pa. (1980); Kohl et al., *Immunology,* 48:187 (1983)); while the variable region determines the antigen with which it will react. Light chains are classified as either κ (kappa) or λ (lambda). Each heavy chain class can be prepared with either kappa or lambda light chain. The light and heavy chains are covalently bonded to each other, and the "tail" portions of the two heavy chains are bonded to each other by covalent disulfide linkages when the immunoglobulins are generated either by hybridomas or by B-cells.

The expression "variable region" or "VR" refers to the domains within each pair of light and heavy chains in an antibody that are involved directly in binding the antibody to the antigen. Each heavy chain has at one end a variable domain ($V_H$) followed by a number of constant domains. Each light chain has a variable domain ($V_L$) at one end and a constant domain at its other end; the constant domain of the light chain is aligned with the first constant domain of the heavy chain, and the light chain variable domain is aligned with the variable domain of the heavy chain.

The expressions "complementarity determining region," "hypervariable region," or "CDR" refer to one or more of the hyper-variable or complementarity determining regions ("CDRs") found in the variable regions of light or heavy chains of an antibody (See Kabat et al., *Sequences of Proteins of Immunological Interest,* 4$^{th}$ ed., Bethesda, Md.: U.S. Dept. of Health and Human Services, Public Health Service, National Institutes of Health (1987)). These expressions include the hypervariable regions as defined by Kabat et al., (*Sequences of Proteins of Immunological Interest,* NIH Publication No. 91-3242, Bethesda, Md.: U.S. Dept. of Health and Human Services, National Institutes of Health (1983)) or the hypervariable loops in 3-dimensional structures of antibodies (Chothia and Lesk, *J. Mol. Biol.,* 196: 901-917 (1987)). The CDRs in each chain are held in close proximity by framework regions ("FRs") and, with the CDRs from the other chain, contribute to the formation of the antigen binding site. Within the CDRs there are select amino acids that have been described as the selectivity determining regions ("SDRs") that represent the critical contact residues used by the CDR in the antibody-antigen interaction (see Kashmiri et al., *Methods,* 36(1):25-34 (2005)).

An "epitope" or "binding site" is an area or region on an antigen to which an antigen-binding peptide (such as an antibody) specifically binds. A protein epitope may comprise amino acid residues directly involved in the binding (also called immunodominant component of the epitope) and other amino acid residues, which are not directly involved in the binding, such as amino acid residues that are effectively blocked by the specifically antigen binding peptide (in other words, the amino acid residue is within the "footprint" of the specifically antigen binding peptide). The term epitope herein includes both types of amino acid binding sites in any particular region of PACAP, i.e., PACAP38 and PACAP27, that specifically binds to an anti-PACAP antibody. PACAP may comprise a number of different epitopes, which may include, without limitation, (1) linear peptide antigenic determinants, (2) conformational antigenic determinants that consist of one or more non-contiguous amino acids located near each other in a mature PACAP conformation; and (3) post-translational antigenic determinants that consist, either in whole or part, of molecular structures covalently attached to a PACAP protein such as carbohydrate groups. In particular, the term "epitope" includes the specific residues in a protein or peptide, e.g., PACAP, which are involved in the binding of an antibody to such protein or peptide as determined by known and accepted methods such as alanine scanning techniques. Such methods are exemplified herein.

The phrase that an antibody (e.g., first antibody) binds "substantially" or "at least partially" the same epitope as another antibody (e.g., second antibody) means that the epitope binding site for the first antibody comprises at least 10%, 20%, 30%, 40%, 50%, 60%, 70%, 80%, 90%, or more of the amino acid residues on the antigen that constitutes the epitope binding site of the second antibody. Also, that a first antibody binds substantially or partially the same or overlapping epitope as a second antibody means that the first and second antibodies compete in binding to the antigen, as described above. Thus, the term "binds to substantially the same epitope or determinant as" a monoclonal antibody means that an antibody "competes" with the antibody.

The phrase "binds to the same or overlapping epitope or determinant as" an antibody of interest means that an antibody "competes" with said antibody of interest for at least one, (e.g., at least 2, at least 3, at least 4, at least 5) or all residues on PACAP to which said antibody of interest specifically binds. The identification of one or more antibodies that bind(s) to substantially or essentially the same epitope as the monoclonal antibodies described herein can be readily determined using alanine scanning. Additionally, any one of variety of immunological screening assays in which antibody competition can be assessed. A number of such assays are routinely practiced and well known in the art (see, e.g., U.S. Pat. No. 5,660,827, issued Aug. 26, 1997, which is specifically incorporated herein by reference). It will be understood that actually determining the epitope to which an antibody described herein binds is not in any way required to identify an antibody that binds to the same or substantially the same or overlapping epitope as the monoclonal antibody described herein.

For example, where the test antibodies to be examined are obtained from different source animals, or are even of a different Ig isotype, a simple competition assay may be employed in which the control antibody is mixed with the test antibody and then applied to a sample containing PACAP. Protocols based upon ELISAs, radioimmunoassays, Western blotting, and the use of BIACORE® (GE Healthcare Life Sciences, Marlborough, Mass.) analysis are suitable for use in such simple competition studies.

In certain embodiments, the control anti-PACAP antibody is pre-mixed with varying amounts of the test antibody (e.g., in ratios of about 1:1, 1:2, 1:10, or about 1:100) for a period of time prior to applying to the PACAP38 or PACAP27 antigen sample. In other embodiments, the control and varying amounts of test antibody can simply be added separately and admixed during exposure to the PACAP38 or PACAP27 antigen sample. As long as bound antibodies can be distinguished from free antibodies (e.g., by using separation or washing techniques to eliminate unbound antibodies) and control antibody from the test antibody (e.g., by using species specific or isotype specific secondary antibodies or by specifically labeling the control antibody with a detectable label) it can be determined if the test antibody reduces the binding of the control antibody to the PACAP38 or PACAP27 antigens, indicating that the test antibody recognizes substantially the same epitope as the control anti-PACAP antibody. The binding of the (labeled) control antibody in the presence of a completely irrelevant antibody (that does not bind PACAP) can serve as the control high value. The control low value can be obtained by incubating the labeled control antibody with the same but unlabeled control antibody, where competition would occur and reduce binding of the labeled antibody. In a test assay, a significant reduction in labeled antibody reactivity in the presence of a test antibody is indicative of a test antibody that recognizes substantially the same epitope, i.e., one that competes with the labeled control antibody. For example, any test antibody that reduces the binding of the control antibody to PACAP38 or PACAP27 by at least about 50%, such as at least about 60%, or more preferably at least about 70% (e.g., about 65-100%), at any ratio of test antibody between about 1:1 or 1:10 and about 1:100 is considered to be an antibody that binds to substantially the same or overlapping epitope or determinant as the control antibody.

Preferably, such test antibody will reduce the binding of the control antibody to PACAP38 or PACAP27 antigen preferably at least about 50%, at least about 60%, at least about 80%, or at least about 90% (e.g., about 95%) of the binding of the control antibody observed in the absence of the test antibody.

A simple competition assay in which a test antibody is applied at saturating concentration to a surface onto which PACAP38 or PACAP27 is immobilized also may be advantageously employed. The surface in the simple competition assay is preferably a BIACORE® (GE Healthcare Life Sciences, Marlborough, Mass.) chip (or other media suitable for surface plasmon resonance ("SPR") analysis). The binding of a control antibody that binds PACAP38 or PACAP27 to the PACAP-coated surface is measured. This binding to the PACAP38- or PACAP27-containing surface of the control antibody alone is compared with the binding of the control antibody in the presence of a test antibody. A significant reduction in binding to the PACAP38- or PACAP27-containing surface by the control antibody in the presence of a test antibody indicates that the test antibody recognizes substantially the same epitope as the control antibody such that the test antibody "competes" with the control antibody. Any test antibody that reduces the binding of control antibody by at least about 20% or more, at least about 40%, at least about 50%, at least about 70%, or more, can be considered to be an antibody that binds to substantially the same epitope or determinant as the control antibody. Preferably, such test antibody will reduce the binding of the control antibody to PACAP38 or PACAP27 by at least about 50% (e.g., at least about 60%, at least about 70%, or more). It will be appreciated that the order of control and test antibodies can be reversed; i.e. the control antibody can be first bound to the surface and then the test antibody is brought into contact with the surface thereafter in a competition assay. Preferably, the "sandwich-style" binding assay exemplified in Example 9 infra is used. Alternatively, the antibody having greater affinity for PACAP38 or PACAP27 antigen is bound to the PACAP38- or PACAP27-containing surface first, as it will be expected that the decrease in binding seen for the second antibody (assuming the antibodies are competing) will be of greater magnitude. Further examples of such assays are provided in e.g., Saunal and Regenmortel, *J. Immunol. Methods,* 183:33-41 (1995), the disclosure of which is incorporated herein by reference.

In addition, whether an antibody binds the same or overlapping epitope(s) on PACAP as another antibody or the epitope bound by a test antibody may in particular be determined using a Western-blot based assay. In this assay a library of peptides corresponding to the antigen bound by the antibody, the PACAP protein, is made, that comprise overlapping portions of the protein, typically 10-25, 10-20, or 10-15 amino acids long. These different overlapping amino acid peptides encompassing the PACAP sequence are synthesized and covalently bound to a PEPSPOTS™ nitrocellulose membrane (JPT Peptide Technologies, Berlin, Germany). Blots are then prepared and probed according to the manufacturer's recommendations.

Essentially, the immunoblot assay then detects by fluorometric means what peptides in the library bind to the test antibody and thereby can identify what residues on the antigen, i.e., PACAP, interact with the test antibody. (See U.S. Pat. No. 7,935,340, incorporated by reference herein).

Various epitope mapping techniques are known in the art. By way of example, X-ray co-crystallography of the antigen and antibody; NMR; SPR (e.g., at 25° or 37° C.); array-based oligo-peptide scanning (or "pepscan analysis"); site-directed mutagenesis (e.g., alanine scanning); mutagenesis mapping; hydrogen-deuterium exchange; phage display; and limited proteolysis are all epitope mapping techniques that are well known in the art (See, e.g., *Epitope Mapping Protocols: Second Edition, Methods in Molecular Biology*, editors Mike Schutkowski and Ulrich Reineke, $2^{nd}$ Ed., New York, N.Y.: Humana Press (2009), and *Epitope Mapping Protocols, Methods in Molecular Biology*, editor Glenn Morris, $1^{st}$ Ed., New York, N.Y.: Humana Press (1996), both of which are herein incorporated by referenced in their entirety).

The identification of one or more antibodies that bind(s) to substantially or essentially the same epitope as the monoclonal antibodies described herein, e.g., Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H can be readily determined using any one of variety of immunological screening assays in which antibody competition can be assessed. A number of such assays are routinely practiced and well known in the art (see, e.g., U.S. Pat. No. 5,660,827, issued Aug. 26, 1997, which is incorporated herein by reference). It will be understood that determining the epitope to which an antibody described herein binds is not in any way required to identify an antibody that binds to the same or substantially the same epitope as the monoclonal antibody described herein.

For example, where the test antibodies to be examined are obtained from different source animals, or are even of a different Ig isotype, a simple competition assay may be employed in which the control antibody (one of Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H, for example) is mixed with the test antibody and then applied to a sample containing either or both PACAP38 and PACAP27, each of which is known to be bound by Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, and Ab12.H. Protocols based upon ELISAs, radioimmunoassays, Western blotting, and BIACORE® (GE Healthcare Life Sciences, Marlborough, Mass.) analysis (as described in the Examples section herein) are suitable for use in such simple competition studies.

In certain embodiments, the method comprises pre-mixing the control antibody with varying amounts of the test antibody (e.g., in ratios of about 1:1, 1:2, 1:10, or about 1:100) for a period of time prior to applying to the PACAP antigen sample. In other embodiments, the control and varying amounts of test antibody can be added separately and admixed during exposure to the PACAP antigen sample. As long as bound antibodies can be distinguished from free antibodies (e.g., by using separation or washing techniques to eliminate unbound antibodies) and control antibody from the test antibody (e.g., by using species specific or isotype specific secondary antibodies or by specifically labelling the control antibody with a detectable label), the method can be used to determine that the test antibody reduces the binding of the control antibody to the PACAP antigen, indicating that the test antibody recognizes substantially the same epitope as the control antibody (e.g., Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H). The binding of the (labeled) control antibody in the presence of a completely irrelevant antibody (that does not bind PACAP) can serve as the control high value. The control low value can be obtained by incubating the labeled control antibody with the same but unlabeled control antibody, where competition would occur and reduce binding of the labeled antibody. In a test assay, a significant reduction in labeled antibody reactivity in the presence of a test antibody is indicative of a test antibody that recognizes substantially the same epitope, i.e., one that competes with the labeled control antibody. For example, any test antibody that reduces the binding of Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H to both of PACAP38 and PACAP27 antigens by at least about 50%, such as at least about 60%, or more preferably at least about 70% (e.g., about 65-100%), at any ratio of control Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H:test antibody or Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H:test antibody between about 1:1 or 1:10 and about 1:100 is considered to be an antibody that binds to substantially the same epitope or determinant as Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H, respectively. Preferably, such test antibody will reduce the binding of Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H to at least one, preferably each, of the PACAP38 and PACAP27 antigens preferably at least about 50%, at least about 60%, at least about 80% or at least about 90% (e.g., about 95%) of the binding of Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H observed in the absence of the test antibody. These methods can be adapted to identify and/or evaluate antibodies that compete with other control antibodies.

A simple competition assay in which a test antibody is applied at saturating concentration to a surface onto which either PACAP38 or PACAP27, or both, are immobilized also may be advantageously employed. The surface in the simple competition assay is preferably of a media suitable for OCTET® and/or PROTEON®. The binding of a control antibody (e.g., Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H) to the PACAP-coated surface is measured. This binding to the PACAP-containing surface of the control antibody alone is compared with the binding of the control antibody in the presence of a test antibody. A significant reduction in binding to the PACAP-containing surface by the control antibody in the presence of a test antibody indicates that the test antibody recognizes substantially the same epitope as the control antibody such that the test antibody "competes" with the control antibody. Any test antibody that reduces the binding of control antibody (such as Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H) to both of PACAP38 and PACAP27 antigens by at least about 20% or more, at least about 40%, at least about 50%, at least about 70%, or more, can be considered to be an antibody that binds to substantially the same epitope or determinant as the control antibody (e.g., Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H). Preferably, such test antibody will reduce the binding of the control antibody (e.g., Ab1, Ab2, Ab3, Ab4, Ab5, Ab6, Ab7, Ab8, Ab9, Ab11, Ab12, Ab13, Ab14, Ab15, Ab16, Ab17, Ab18, Ab19, Ab22, Ab23, Ab1.H, Ab3.H, Ab4.H, Ab5.H, Ab9.H, or Ab12.H) to the PACAP antigen by at least about 50% (e.g., at least about 60%, at least about 70%, or more). It will be appreciated that the order of control and test antibodies can be reversed; i.e. the control antibody can be first bound to the surface and then the test antibody is brought into contact with the surface thereafter in a competition assay. Preferably, the antibody having higher affinity for PACAP38 and PACAP27 is bound to the PACAP-containing surface first, as it will be expected that the decrease in binding seen for the second antibody (assuming the antibodies are competing) will be of greater magnitude. Further examples of such assays are provided in, e.g., Saunal and Regenmortel, *J. Immunol. Methods*, 183: 33-41 (1989), the disclosure of which is incorporated herein by reference.

Determination of whether an antibody, antigen binding fragment thereof, or antibody derivative binds within one of the epitope regions defined above can be carried out in ways known to the person skilled in the art. In another example of such mapping/characterization methods, an epitope region for an anti-PACAP antibody may be determined by epitope "footprinting" using chemical modification of the exposed amines/carboxyls in the PACAP38 and PACAP27 protein. One specific example of such a foot-printing technique is the use of hydrogen-deuterium exchange detected by mass spectrometry ("HXMS"), wherein a hydrogen/deuterium exchange of receptor and ligand protein amide protons, binding, and back exchange occurs, wherein the backbone amide groups participating in protein binding are protected from back exchange and therefore will remain deuterated. Relevant regions can be identified at this point by peptic proteolysis, fast microbore high-performance liquid chromatography separation, and/or electrospray ionization mass spectrometry (See, e.g., Ehring H., *Analytical Biochemistry*, 267(2):252-259 (1999) and Engen, J. R. & Smith, D. L., *Anal. Chem.*, 73:256A-265A (2001)). Another example of a suitable epitope identification technique is nuclear magnetic resonance epitope mapping ("NMR"), where typically the position of the signals in two-dimensional NMR spectres of the free antigen and the antigen complexed with the antigen binding peptide, such as an antibody, are compared. The antigen typically is selectively isotopically labeled with $^{15}$N so that only signals corresponding to the antigen and no signals from the antigen binding peptide are seen in the NMR-spectrum. Antigen signals originating from amino acids involved in the interaction with the antigen binding peptide typically will shift position in the spectres of the complex compared to the spectres of the free antigen, and the amino acids involved in the binding can be identified that way. See, e.g., *Ernst Schering Res. Found. Workshop*, (44): 149-67 (2004); Huang et al., *J. Mol. Biol.*, 281(1):61-67 (1998); and Saito and Patterson, *Methods*, 9(3):516-24 (1996). Epitope mapping/characterization also can be performed using mass spectrometry ("MS") methods (See, e.g., Downard, *J. Mass Spectrom.*, 35(4):493-503 (2000) and Kiselar and Downard, *Anal. Chem.*, 71(9):1792-801 (1999)).

Protease digestion techniques also can be useful in the context of epitope mapping and identification. Antigenic determinant-relevant regions/sequences can be determined by protease digestion, e.g. by using trypsin in a ratio of about 1:50 to PACAP38 or PACAP27 overnight ("o/n") digestion at 37° C. and pH 7-8, followed by mass spectrometry ("MS") analysis for peptide identification. The peptides protected from trypsin cleavage by the anti-PACAP antibody can subsequently be identified by comparison of samples subjected to trypsin digestion and samples incubated with antibody and then subjected to digestion by e.g. trypsin (thereby revealing a footprint for the antibody). Other enzymes like chymotrypsin or pepsin can be used in similar epitope characterization methods. Moreover, enzymatic digestion can provide a quick method for analyzing whether a potential antigenic determinant sequence is within a region of PACAP in the context of a PACAP-binding polypeptide. If the polypeptide is not surface exposed, it is most likely not relevant in terms of immunogenicity/antigenicity (See, e.g., Manca, *Ann. Ist. Super. Sanità*, 27(1):15-9 (1991) for a discussion of similar techniques).

Site-directed mutagenesis is another technique useful for characterization of a binding epitope. For example, in "alanine-scanning" site-directed mutagenesis (also known as alanine scanning, alanine scanning mutagenesis, alanine scanning mutations, combinatorial alanine scanning, or creation of alanine point mutations, for example), each residue within a protein segment is replaced with an alanine residue (or another residue such as valine where alanine is present in the wild-type sequence) through such methodologies as direct peptide or protein synthesis, site-directed mutagenesis, the GENEART™ Mutagenesis Service (Thermo Fisher Scientific, Waltham, Mass. U.S.A.) or shotgun mutagenesis, for example. A series of single point mutants of the molecule is thereby generated using this technique; the number of mutants generated is equivalent to the number of residues in the molecule, each residue being replaced, one at a time, by a single alanine residue. Alanine is generally used to replace native (wild-type) residues because of its non-bulky, chemically inert, methyl functional group that can mimic the secondary structure preferences that many other amino acids may possess. Subsequently, the effects replacing a native residue with an alanine has on binding affinity of an alanine scanning mutant and its binding partner can be measured using such methods as, but not limited to, SPR binding experiments. If a mutation leads to a significant reduction in binding affinity, it is most likely that the mutated residue is involved in binding. Monoclonal antibodies specific for structural epitopes (i.e., antibodies that do not bind the unfolded protein) can be used as a positive control for binding affinity experiments to verify that the alanine-replacement does not influence the overall tertiary structure of the protein (as changes to the overall fold of the protein may indirectly affect binding and thereby produce a false positive result). See, e.g., Clackson and Wells, *Science*, 267:383-386 (1995); Weiss et al., *Proc. Natl. Acad. Sci. USA*, 97(16):8950-8954 (2000); and Wells, *Proc. Natl. Acad. Sci. USA*, 93:1-6 (1996). In Example 12 alanine scanning methods are used to identify the specific epitope or residues of PACAP which specifically interact with the anti-PACAP antibodies disclosed herein.

Electron microscopy can also be used for epitope "foot-printing". For example, Wang et al., *Nature*, 355:275-278 (1992) used coordinated application of cryoelectron microscopy, three-dimensional image reconstruction, and X-ray crystallography to determine the physical footprint of a Fab-fragment on the capsid surface of native cowpea mosaic virus.

Other forms of "label-free" assay for epitope evaluation include SPR (sold commercially as the BIACORE® system, GE Healthcare Life Sciences, Marlborough, Mass.) and reflectometric interference spectroscopy ("RifS") (See, e.g., Fagerstam et al., *Journal of Molecular Recognition*, 3:208-14 (1990); Nice et al., *J. Chromatogr.*, 646:159-168 (1993); Leipert et al., *Angew. Chem. Int. Ed.*, 37:3308-3311 (1998); Kroger et al., *Biosensors and Bioelectronics*, 17:937-944 (2002)).

The expressions "framework region" or "FR" refer to one or more of the framework regions within the variable regions of the light and heavy chains of an antibody (See Kabat et al., *Sequences of Proteins of Immunological Interest*, 4$^{th}$ edition, Bethesda, Md.: U.S. Dept. of Health and Human Services, Public Health Service, National Institutes of Health (1987)). These expressions include those amino acid sequence regions interposed between the CDRs within the variable regions of the light and heavy chains of an antibody.

The term "Fc region" is used to define a C-terminal region of an immunoglobulin heavy chain. The "Fc region" may be a native sequence Fc region or a variant Fc region. Although the boundaries of the Fc region of an immunoglobulin heavy chain might vary, the human IgG heavy chain Fc region is usually defined to stretch from an amino acid residue at position Cys226, or from Pro230, to the carboxyl-terminus thereof. The numbering of the residues in the Fc region is that of the EU index as in Kabat. Kabat et al., *Sequences of Proteins of Immunological Interest*, 5th edition, Bethesda, Md.: U.S. Dept. of Health and Human Services, Public Health Service, National Institutes of Health (1991). The Fc region of an immunoglobulin generally comprises two constant domains, CH2 and CH3.

The terms "Fc receptor" and "FcR" describe a receptor that binds to the Fc region of an antibody. The preferred FcR is a native sequence human FcR. Moreover, a preferred FcR is one that binds an IgG antibody (a gamma receptor) and includes receptors of the FcγRI, FcγRII, and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. FcRs are reviewed in Ravetch and Kinet, *Ann. Rev. Immunol.*, 9:457-92 (1991); Capel et al., *Immunomethods*, 4:25-34 (1994); and de Haas et al., *J. Lab. Clin. Med.*, 126:330-41 (1995). "FcR" also includes the neonatal receptor, FcRn, which is responsible for the transfer of maternal IgGs to the fetus (Guyer et al., *J. Immunol.*, 117:587 (1976); and Kim et al., *J. Immunol.*, 24:249 (1994)), and which primarily functions to modulate and/or extend the half-life of antibodies in circulation. To the extent that the disclosed anti-PACAP antibodies are aglycosylated, as a result of the expression system and/or sequence, the subject antibodies are expected to bind FcRn receptors, but not to bind (or to minimally bind) Fcγ receptors.

A "functional Fc region" possesses at least one effector function of a native sequence Fc region. Exemplary "effector functions" include C1q binding; complement dependent cytotoxicity ("CDC"); Fc receptor binding; antibody-dependent cell-mediated cytotoxicity ("ADCC"); phagocytosis; down-regulation of cell surface receptors (e.g. B cell receptor ("BCR")), etc. Such effector functions generally require the Fc region to be combined with a binding domain (e.g. an antibody variable domain) and can be assessed using various assays known in the art for evaluating such antibody effector functions.

A "native sequence Fc region" comprises an amino acid sequence identical to the amino acid sequence of an Fc region found in nature. A "variant Fc region" comprises an amino acid sequence that differs from that of a native sequence Fc region by virtue of at least one amino acid modification, yet retains at least one effector function of the native sequence Fc region. Preferably, the variant Fc region has at least one amino acid substitution compared to a native sequence Fc region or to the Fc region of a parent polypeptide, e.g. from about one to about ten amino acid substitutions, and preferably from about one to about five amino acid substitutions in a native sequence Fc region or in the Fc region of the parent polypeptide. The variant Fc region herein will preferably possess at least about 80% sequence identity with a native sequence Fc region and/or with an Fc region of a parent polypeptide, and most preferably at least about 90% sequence identity therewith, more preferably at least about 95%, at least about 96%, at least about 97%, at least about 98%, or at least about 99% sequence identity therewith.

Anti-PACAP Antibodies and Binding Fragments Thereof Having Binding Activity for PACAP PACAP is a multifunctional vasodilatory peptide with expression throughout the central nervous system ("CNS") and periphery. PACAP is a member of the secretin/VIP/GRH family. PACAP exists in two α-amidated active forms, PACAP38 (SEQ ID NO: 1241) and PACAP27 (SEQ ID NO: 1242). Herein, the term "PACAP" includes either or both of PACAP38 and PACAP27 unless expressly indicated otherwise. PACAP is highly conserved between species.

In humans, PACAP is derived from a 176 amino acid precursor protein (preproPACAP) and the gene is located on chromosome 18p11, with PACAP38 encoded for by exon 5 (Vaudry et al., *Pharmacol. Rev.*, 61:283-357 (2009)). PreproPACAP contains an N-terminal 24 amino acid signal protein, a 29 amino acid PACAP-related peptide and PACAP in the C-terminal domain. The precursor is metabolized by prohormone convertase enzymes into biologically active PACAP38 and PACAP27.

VIP (SEQ ID NO: 1243) belongs to the same protein family as PACAP and shares high homology with PACAP, i.e., VIP and PACAP27 have 68% sequence homology at the amino acid level, as well as similar overall secondary structure, i.e. long alpha-helical structures at the C-terminus.

PACAP's actions are mediated via three different G-protein coupled receptors: PAC1-R, VPAC1-R, and VPAC2-R. VPAC1-R can associate with all of the receptor-associated membrane proteins ("RAMPs", Kaiser & Russo, *Neuropeptides* 47: 451-461 (2013)). PAC1-R is selective for PACAP, whereas VPAC1-R and VPAC2-R bind to both VIP and PACAP with high affinity. PAC1-R binds to PACAP with 100-1000-fold higher affinity than VIP, i.e., $K_D$ ~0.5 nM for PACAP27/PACAP38 vs. $K_D$ ~500 nM for VIP. Conversely, VPAC1-R and VPAC2-R have equal affinities for PACAP and VIP ($K_D$ ~1 nM) (See Schytz et al. (2010)). All three receptors are widely expressed in both peripheral tissues and in the CNS, with PAC1-R predominantly expressed in the CNS, most abundantly in the olfactory bulb, thalamus, hypothalamus, the dentate gyrus of the hippocampus and in granule cells of the cerebellum (Hashimoto et al., *J. Comp. Neurol.*, 371:567-577 (1996); Shioda et al., *Neurosci. Res.*, 28:345-354 (1997)).

Activation of the PAC1-R, VPAC1-R, and/or VPAC2-R results in increased adenylate cyclase activity and, thus, increased cAMP production. However, PACAP receptors can also mediate their effects through PLC, leading to increased $Ca^{2+}$ levels, and PLD.

PACAP has a wide range of biological effects, including a role in neurodevelopment, neuroprotection, neuromodulation, neurogenic inflammation, and nociception. PACAP is also reported to interact with glycosaminoglycans ("GAGs"). GAGs are long, unbranched polysaccharides composed of repeating disaccharide units, such as heparin, chondroitin, keratin, and hyaluronic acid. It has been shown that the cellular uptake of PACAP is dependent on the expression of GAG proteins and that PACAP bound to sulfated GAGs. Particularly, it was determined that PACAP38 binding to GAGs was capable of inducing receptor-independent cellular uptake of PACAP38. This study further demonstrated that a random coil-to-α-helix transition in PACAP38 was essential for GAG-dependent uptake of PACAP38, as a mutant PACAP38 that could not undergo the structural transition was not internalized by GAG-containing cell lines as efficiently as the wild-type form of PACAP38 (Neree et al., *FEBS Lett.*, 588(24):4590-4596, 2014). In a follow up study, it was determined that PACAP's ability to cluster GAGs, i.e., heparin, was directly related to its ability to function as a cell penetrating peptide ("CPP"). It is hypothesized that this activity is attributable to the heparin-binding, or Cardin-Weintraub, motif found in secretin/glucagon/GHRH family members, such as PACAP (Neree et al., *Int. J. Mol. Sci.*, 16:27391-27400, 2015). Interestingly, Neree et al. (2015) presented data demonstrating that PACAP38 was able to cluster sulfated GAGs in vitro. These data suggested that the observed clustering effect is important for the GAG-mediated cellular uptake of PACAP38, as other peptides, such as glucagon, displayed higher binding affinities for sulfated GAGs (heparin) but are not internalized by cells as efficiently as PACAP38. Further, it is reported that in in vitro studies in which cells are exposed to PACAP, cartilage formation is increased, including cartilage matrix that is rich in sulphated GAG proteins, consistent with its putative protective role expressed during various cellular stress responses (Juhász et al., PLoS ONE, 9(3):e91541, 2014). Using cell types that lack PACAP-specific receptors on their plasma membranes, such as CHO-K1 cells, Doan et al. presented data demonstrating the ability of such cells to engage in receptor-independent cellular uptake of various forms of fluorescently-labeled PACAP38 and PACAP27 (Doan et al., Biochem. Biophys. Acta, 1823:940-949, 2012).

The present invention provides exemplary antibodies or antigen binding fragments thereof that bind PACAP, including human PACAP. Other antibodies or antigen binding fragments thereof that bind PACAP, including those having different CDRs, and epitopic specificity may be obtained using the disclosure of the present specification, and using methods that are generally known in the art. Such antibodies and antigen binding fragments thereof antagonize the biological effects of PACAP in vivo and therefore are useful in treating or preventing PACAP-related conditions including, for example, headache, migraine, pain, photophobia, hot flush, PTSD, and anxiety disorders. In preferred embodiments, the antibody or antigen binding fragment thereof according to the invention comprises one or more CDRs, a $V_L$ chain and/or $V_H$ chain of the anti-PACAP antibodies and antigen binding fragments thereof described herein.

In some embodiments, an anti-PACAP antibody or antigen binding fragment thereof according to the invention will interfere with, block, reduce, or modulate the interaction between PACAP and its receptor(s) (e.g., PAC1-R, VPAC1-R, and VPAC2-R). In some instances an anti-PACAP antibody or antigen binding fragment thereof according to the invention is "neutralizing", e.g., it totally prevents the specific interaction of PACAP with PAC1-R, VPAC1-R, and/or VPAC2-R. In some embodiments, the antibody or antigen binding fragment thereof neutralizes PACAP, e.g., by remaining bound to PACAP in a location and/or manner that prevents PACAP from specifically binding to PAC1-R, VPAC1-R, and/or VPAC2-R.

In some embodiments, the antibody or antigen binding fragment thereof according to the invention is capable of inhibiting PACAP-mediated activity (including binding to PAC1-R-expressing cells). In some embodiments, the antibody or antigen binding fragment thereof according to the invention are humanized, such as humanized rabbit antibodies to PACAP.

As mentioned, the anti-PACAP antibodies or antigen binding fragments thereof according to the invention have a variety of uses. For example, the subject antibodies and fragments can be useful in therapeutic applications, as well as diagnostically in binding assays. The subject anti-PACAP antibodies or antigen binding fragments thereof are useful for affinity purification of PACAP, in particular human PACAP or its ligands and in screening assays to identify other antagonists of PACAP activity. Some of the antibodies or antigen binding fragments thereof are useful for inhibiting binding of PACAP to PAC1-R, VPAC1-R, and/or VPAC2-R, or inhibiting PACAP-mediated activities and/or biological effects.

As used herein, the term "one or more biological effects associated with PACAP refers to any biological effect mediated, induced, or otherwise attributable to PACAP, e.g., binding properties, functional properties, and other properties of biological significance. Non-limiting exemplary biological effects of PACAP include PACAP binding to PAC1-R, VPAC1-R, GAGs, and/or VPAC2-R; PACAP activating PAC1-R, VPAC1-R, and/or VPAC2-R-mediated signaling; PACAP-mediated increase in cAMP production; PACAP-mediated increase in PLC activity; PACAP-mediated increase in PLD activity; PACAP-mediated increase in $Ca^{2+}$ levels; and PACAP-mediated vasodilation, photophobia, mast cell degranulation, and/or neuronal activation. The subject anti-PACAP antibodies are capable of inhibiting one, a combination of, or all of these exemplary PACAP biological activities. For example, the anti-PACAP antibodies and antigen binding fragments thereof provided herein are capable of inhibiting PACAP-induced vasodilation (see Example 7 and Example 8).

The antibody or antigen binding fragment thereof according to the invention can be used in a variety of therapeutic applications. For example, in some embodiments the anti-PACAP antibody or antigen binding fragment thereof are useful for treating conditions associated with PACAP, such as, but not limited to, migraine (with or without aura), hemiplegic migraines, cluster headaches, migrainous neuralgia, chronic headaches, tension headaches, general headaches, hot flush, photophobia, chronic paroxysmal hemicrania, secondary headaches due to an underlying structural problem in the head or neck, cranial neuralgia, sinus headaches (e.g., headache associated with sinusitis), allergy-induced headaches or migraines, pain, chronic pain, neuroinflammatory or inflammatory pain, post-operative incision pain, post-surgical pain, trauma-related pain, eye pain, tooth pain, complex regional pain syndrome, cancer pain (e.g., primary or metastatic bone cancer pain), fracture pain, osteoporotic fracture pain, pain resulting from burn, gout joint pain, pain associated with sickle cell crises, pain associated with temporomandibular disorders, cirrhosis, hepatitis, neurogenic pain, neuropathic pain, nociceptic pain, visceral pain, trigeminal neuralgia, post-herpetic neuralgia, phantom limb pain, fibromyalgia, menstrual pain, ovarialgia, reflex sympathetic dystrophy, osteoarthritis or rheumatoid arthritis pain, lower back pain, diabetic neuropathy, sciatica, dyspepsia, irritable bowel syndrome, inflammatory bowel disease, Crohn's disease, ileitis, ulcerative colitis, renal colic, dysmenorrhea, cystitis, interstitial cystitis, menstrual period, labor, menopause, pancreatitis, schizophrenia, depression, PTSD, anxiety disorders, diabetes, autoimmune diabetes, endothelial dysfunction, ischemia, Raynaud's syndrome, coronary heart disease ("CHD"), coronary artery disease ("CAD"), heart failure, peripheral arterial disease ("PAD"), pulmonary hypertension ("PH"), connective tissue disorders, stroke, Sjögren's syndrome, multiple sclerosis, bronchial hyperreactivity, asthma, bronchitis, bronchodilation, emphysema, chronic obstructive pulmonary disease ("COPD"), inflammatory dermatitis, adenocarcinoma in glandular tissue, blastoma in embryonic tissue of organs, carcinoma in epithelial tissue, leukemia in tissues that form blood cells, lymphoma in lymphatic tissue, myeloma in bone marrow, sarcoma in connective or supportive tissue, adrenal cancer, AIDS-related lymphoma, anemia, bladder cancer, bone cancer, brain cancer, breast cancer, carcinoid tumors, cervical cancer, chemotherapy, colon cancer, cytopenia, endometrial cancer, esophageal cancer, gastric cancer, head cancer, neck cancer, hepatobiliary cancer, kidney cancer, leukemia, liver cancer, lung cancer, lymphoma, Hodgkin's disease, non-Hodgkin's, nervous system tumors, oral cancer, ovarian cancer, pancreatic cancer, prostate cancer, rectal cancer, skin cancer, stomach cancer, testicular cancer, thyroid cancer, urethral cancer, cancer of bone marrow, multiple myeloma, tumors that metastasize to the bone, tumors infiltrating the nerve and hollow viscus, tumors near neural structures, acne vulgaris, atopic dermatitis, urticaria, keloids, hypertrophic scars and rosacea, allergic dermatitis, psoriasis, pruritus, neurogenic cutaneous redness, erythema, weight loss, anorexia, sarcoidosis, shock, sepsis, opiate withdrawal syndrome, morphine tolerance, epilepsy, LUT disorders such as urinary tract infection, abnormal voiding, urinary urgency, nocturia, urinary incontinence, overactive bladder, and for preventing or alleviating the pain associated with such LUT conditions.

Specific examples of visceral pain, i.e., pain associated with the viscera, or the internal organs of the body include pain that affects organs such as e.g., the heart, lungs, reproductive organs, bladder, ureters, the digestive organs, liver, pancreas, spleen, and kidneys. Conditions associated therewith include by way of example pancreatitis, labor, abdominal surgery associated with ileus, cystitis, menstrual period, or dysmenorrhea. Likewise, kidney pain, epigastric pain, pleural pain, and painful biliary colic, appendicitis pain may all be considered to be visceral pain. Substernal pain or pressure from early myocardial infarction is also visceral. Diseases of the stomach, duodenum or colon can cause visceral pain. Commonly encountered gastrointestinal ("GI") disorders that cause visceral pain include functional bowel disorder ("FBD") and inflammatory bowel disease ("IBD"). Such GI disorders may further include gastroesophageal reflux, dyspepsia, irritable bowel syndrome ("IBS") and functional abdominal pain syndrome ("FAPS"), and, with respect to IBD, Crohn's disease, ileitis, and ulcerative colitis.

The subject anti-PACAP antibodies and antigen binding fragments thereof may be used alone or in association with other active agents or drugs, including other biologics, to treat any subject in which blocking, inhibiting, or neutralizing the in vivo effect of PACAP or blocking or inhibiting the interaction of PACAP and its receptors, PAC1-R, VPAC1-R, and VPAC2-R, is therapeutically desirable.

Exemplary anti-PACAP antibodies and antigen binding fragments thereof according to the invention, and the specific CDRs thereof are identified in this section. For convenience, each exemplified antibody or antigen binding fragment thereof, and corresponding sequences are separately identified by a specific nomenclature, i.e., Ab1, Ab1.H, Ab2, Ab3, Ab3.H, Ab4, Ab4.H, Ab5, Ab5.H, Ab6, Ab7, Ab8, Ab9, Ab9.H, Ab11, Ab12, Ab12.H, Ab13, Ab14, Ab15, Ab16, Ab17, Ab18, Ab19, Ab22, and Ab23.

The anti-PACAP antibodies and antigen binding fragments thereof comprising the invention have binding affinity for PACAP, wherein the binding affinity comprises anti-PACAP antibodies or antigen binding fragments thereof specifically binding to PACAP38 and PACAP27, but not binding VIP, and/or antibodies or antigen binding fragments thereof specifically binding to PACAP38, but not binding to PACAP27 or VIP, and/or antibodies or antigen binding fragments thereof specifically binding to a linear and/or conformational epitope within PACAP38 and/or PACAP27. More specifically, the epitopes of PACAP38 and/or PACAP27 to which antagonistic anti-PACAP antibodies or antigen binding fragments thereof according to the invention bind will include those which are identified in Example 12 or residues thereof (as determined by use of alanine scanning) and/or other epitopic identification methods.

Anti-PACAP Antibody Polypeptide Sequences
Antibody Ab3.H

In one embodiment, the invention includes antibodies and antigen-binding fragments having binding specificity to PACAP that possess a heavy chain sequence comprising the sequence of SEQ ID NO: 1121 which consists of the heavy chain variable region of SEQ ID NO: 1122 linked to the heavy chain constant region of SEQ ID NO: 1130.

In one embodiment, the invention includes antibodies and antigen-binding fragments having binding specificity to PACAP that contain a heavy chain variable region sequence comprising the sequence set forth below:

```
                                        (SEQ ID NO: 1122)
EVQLVESGGGLVQPGGSLRLSCAASGFSFSSSDYMCWVRQAPGKGLEWI

GCIDAGSSGDTYFASSAKGRFTISRDNSKNTVYLQMNSLRAEDTAVYFC

ARHLYGSITFAFGLWGQGTLVTVSS.
```

In another embodiment, the invention includes antibodies and antigen-binding fragments having binding specificity to PACAP that bind the same epitope as Ab3.H, and that contain a heavy chain constant region sequence comprising the polypeptide of SEQ ID NO: 1244, 1245, or 1246, or comprising the sequence set forth below:

```
                                        (SEQ ID NO: 1130)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPSVFLFPPKPKDTLMISRTPEVTCVVV

DVSHEDPEVKFNWYVDGVEVHNAKTKPREEQYASTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPG.
```

In another embodiment, the invention includes antibodies and antigen-binding fragments having binding specificity to PACAP that contain a light chain sequence comprising the sequence of SEQ ID NO: 1141 which consists of the light chain variable region of SEQ ID NO: 1142 linked to the light chain constant region of SEQ ID NO: 1150.

In another embodiment, the invention includes antibodies and antigen-binding fragments having binding specificity to PACAP that contain a light chain variable region sequence comprising the sequence set forth below:

```
                                        (SEQ ID NO: 1142)
AAQMTQSPSTLSASVGDRVTITCQASQSIGSDLAWYQQKPGKAPKLLIY

DASTLASGVPSRFSGSGSGTEFTLTISSLQPDDFATYYCQGTYYSSGWY

TAFGGGTKVEIKR.
```

In another embodiment, the invention includes antibodies and antigen-binding fragments having binding specificity to PACAP, that bind the same epitope as Ab3.H, and that contain a light chain constant region sequence comprising the sequence set forth below:

```
                                        (SEQ ID NO: 1150)
TVAAPSVFIFPPSDEQLKSGTASVVCLLNNFYPREAKVQWKVDNA

LQSGNSQESVTEQDSKDSTYSLSSTLTLSKADYEKHKVYACEVTHQGLSS

PVTKSFNRGEC.
```

In another embodiment, the invention includes antibodies and antigen-binding fragments having binding specificity to PACAP that contain one, two, or three of the polypeptide sequences of SEQ ID NO: 1124; SEQ ID NO: 1126; and SEQ ID NO: 1128, which correspond to the CDRs (hypervariable regions) of the heavy chain sequence of SEQ ID NO: 1121, or which contain the heavy chain variable region sequence of SEQ ID NO: 1122, and/or which further contain one, two, or three of the polypeptide sequences of SEQ ID NO: 1144; SEQ ID NO: 1146; and SEQ ID NO: 1148, which correspond to the CDRs (hypervariable regions) of the light chain sequence of SEQ ID NO: 1141, or which contain the light chain variable region sequence of SEQ ID NO: 1142, or antibodies or antigen-binding fragments containing combinations of sequences that are at least 80%, 85%, 90%, 95%, 96%, 97%, 98%, or 99% identical thereto. In another embodiment of the invention, the antibodies of the invention and antigen-binding fragments comprise, or alternatively consist of, combinations of one or more of the exemplified heavy chain variable region and light chain variable region sequences, or the heavy chain and light chain sequences set forth above, or sequences that are at least 90% or 95% identical thereto.

The invention further contemplates anti-PACAP antibodies and antigen-binding fragments comprising one, two, three, or four of the polypeptide sequences of SEQ ID NO: 1123; SEQ ID NO: 1125; SEQ ID NO: 1127; and SEQ ID NO: 1129, which correspond to the FRs (constant regions) of the heavy chain sequence of SEQ ID NO: 1121, or the heavy chain variable region sequence of SEQ ID NO: 1122, and/or one, two, three, or four of the polypeptide sequences of SEQ ID NO: 1143; SEQ ID NO: 1145; SEQ ID NO: 1147; and SEQ ID NO: 1149, which correspond to the FRs (constant regions) of the light chain sequence of SEQ ID NO: 1141, or the light chain variable region sequence of SEQ ID NO: 1142, or combinations of these polypeptide sequences, or sequences that are at least 80%, 90%, 95%, 96%, 97%, 98%, or 99% identical therewith.

In another embodiment of the invention, the anti-PACAP antibodies and antigen-binding fragments of the invention or fragments comprise, or alternatively consist of, combinations of one or more of the FRs, CDRs, the heavy chain variable region and light chain variable region sequences, and the heavy chain and light chain sequences set forth above, including all of them, or sequences that are at least 90% or 95% identical thereto.

In another embodiment of the invention, the anti-PACAP antibodies and antigen-binding fragments of the invention comprise, or alternatively consist of, the polypeptide sequence of SEQ ID NO: 1121, or SEQ ID NO: 1122, or polypeptides that are at least 90% or 95% identical thereto. In another embodiment of the invention, the antibodies and antigen-binding fragments of the invention comprise, or alternatively consist of, the polypeptide sequence of SEQ ID NO: 1141, or SEQ ID NO: 1142, or polypeptides that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 1124; SEQ ID NO: 1126; and SEQ ID NO: 1128, which correspond to the CDRs (hypervariable regions) of the heavy chain sequence of SEQ ID NO: 1121, or the heavy chain variable region sequence of SEQ ID NO: 1122, or sequences that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 1144; SEQ ID NO: 1146; and SEQ ID NO: 1148, which correspond to the CDRs (hypervariable regions) of the light chain sequence of SEQ ID NO: 1141, or the light chain variable region sequence of SEQ ID NO: 1142, or sequences that are at least 90% or 95% identical thereto.

In a further embodiment of the invention, the antibodies and antigen-binding fragments having binding specificity to PACAP comprise, or alternatively consist of, one, two, three, or four of the polypeptide sequences of SEQ ID NO: 1123; SEQ ID NO: 1125; SEQ ID NO: 1127; and SEQ ID NO: 1129, which correspond to the FRs (constant regions) of the heavy chain sequence of SEQ ID NO: 1121, or the heavy chain variable region sequence of SEQ ID NO: 1122, or sequences that are at least 90% or 95% identical thereto.

In a further embodiment of the invention, the subject antibodies and antigen-binding fragments having binding specificity to PACAP comprise, or alternatively consist of, one, two, three, or four of the polypeptide sequences of SEQ ID NO: 1143; SEQ ID NO: 1145; SEQ ID NO: 1147; and SEQ ID NO: 1149, which correspond to the FRs (constant regions) of the light chain sequence of SEQ ID NO: 1141, or the light chain variable region sequence of SEQ ID NO: 1142, or sequences that are at least 90% or 95% identical thereto.

The invention also contemplates anti-PACAP antibodies and antigen-binding fragments that include one or more of the antibody fragments described herein. In one embodiment of the invention, antibodies and antigen-binding fragments having binding specificity to PACAP comprise, or alternatively consist of, one, two, three, or more, including all of the following antibody fragments: the heavy chain variable region of SEQ ID NO: 1122; the light chain variable region of SEQ ID NO: 1142; the complementarity determining regions (SEQ ID NO: 1124; SEQ ID NO: 1126; and SEQ ID NO: 1128) of the heavy chain variable region of SEQ ID NO: 1122; and the complementarity determining regions (SEQ ID NO: 1144; SEQ ID NO: 1146; and SEQ ID NO: 1148) of the light chain variable region of SEQ ID NO: 1142, or sequences that are at least 90% or 95% identical thereto. In another embodiment of the invention, fragments of the antibodies having binding specificity to PACAP comprise, or alternatively consist of, one, two, three, or more, including all of the following antibody fragments: the heavy chain variable region of SEQ ID NO: 1122; the light chain variable region of SEQ ID NO: 1142; the framework regions (SEQ ID NO: 1123; SEQ ID NO: 1125; SEQ ID NO: 1127; and SEQ ID NO: 1129) of the heavy chain variable region of SEQ ID NO: 1122; and the framework regions (SEQ ID NO: 1143; SEQ ID NO: 1145; SEQ ID NO: 1147; and SEQ ID NO: 1149) of the light chain variable region of SEQ ID NO: 1142, or sequences that are at least 90% or 95% identical thereto.

In another embodiment of the invention, the anti-PACAP antibody is Ab3.H, comprising, or alternatively consisting of, SEQ ID NO: 1121 and SEQ ID NO: 1141, or SEQ ID NO: 1122 and SEQ ID NO: 1142, or an antibody or antigen-binding fragment comprising the CDRs of Ab3.H and having at least one of the biological activities set forth herein, or is an anti-PACAP antibody that competes with Ab3.H in binding PACAP, preferably one containing sequences that are at least 90%, 95%, 96%, 97%, 98%, or 99% identical to that of Ab3.H, or an antibody that binds to the same or overlapping epitope(s) on PACAP as Ab3.H.

In a further embodiment of the invention, antigen-binding fragments comprise, or alternatively consist of, Fab fragments having binding specificity for PACAP. With respect to antibody Ab3.H, the Fab fragment preferably includes the heavy chain variable region sequence of SEQ ID NO: 1122 and the light chain variable region sequence of SEQ ID NO: 1142, or sequences that are at least 90%, 95%, 96%, 97%, 98%, or 99% identical thereto. This embodiment of the invention further includes Fabs containing additions, deletions, and variants of SEQ ID NO: 1122 and/or SEQ ID NO: 1142 that retain the binding specificity for PACAP.

In one embodiment of the invention described herein, Fab fragments may be produced by enzymatic digestion (e.g., papain) of Ab3.H. In another embodiment of the invention, anti-PACAP antibodies such as Ab3.H and Fab fragments may be produced via expression in mammalian cells, such as CHO, NSO, or HEK 293 cells, fungal, insect, or microbial systems, such as yeast cells (for example haploid or diploid yeast, such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PACAP, including the heavy and/or light chains of Ab3.H, as well as fragments, variants, and combinations of one or more of the FRs, CDRs, the heavy chain variable region and light chain variable region sequences, and the heavy chain and light chain sequences set forth above, including all of them, or sequences that are at least 90% or 95% identical thereto.

Antibody Ab4.H

In one embodiment, the invention includes antibodies and antigen-binding fragments having binding specificity to PACAP that possess a heavy chain sequence comprising the sequence of SEQ ID NO: 1081 which consists of the heavy chain variable region of SEQ ID NO: 1082 linked to the heavy chain constant region of SEQ ID NO: 1090.

In one embodiment, the invention includes antibodies and antigen-binding fragments having binding specificity to PACAP that contain a heavy chain variable region sequence comprising the sequence set forth below:

(SEQ ID NO: 1082)
EVQLVESGGGLVQPGGSLRLSCAASGFSLSSYDMSWVRQAPGKGL

EWIGIINTNDDTWYASWVKGRFTISRDNSKNTLYLQMNSLRAEDTAVYYC

ARISDAYVFDYAYYFTLWGQGTLVTVSS.

In another embodiment, the invention includes antibodies and antigen-binding fragments having binding specificity to PACAP that bind the same epitope as Ab4.H, and that contain a heavy chain constant region sequence comprising the polypeptide of SEQ ID NO: 1244, 1245, or 1246, or comprising the sequence set forth below:

(SEQ ID NO: 1090)
ASTKGPSVFPLAPSSKSTSGGTAALGCLVKDYFPEPVTVSWNSGA

LTSGVHTFPAVLQSSGLYSLSSVVTVPSSSLGTQTYICNVNHKPSNTKVD

KKVEPKSCDKTHTCPPCPAPELLGGPSVFLFPPKPKDTLMISRTPEVTCV

VVDVSHEDPEVKFNWYVDGVEVHNAKTKPREEQYASTYRVVSVLTVLHQD

WLNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLTV

DKSRWQQGNVFSCSVMHEALHNHYTQKSLSLSPGK.

In another embodiment, the invention includes antibodies and antigen-binding fragments having binding specificity to PACAP that contain a light chain sequence comprising the sequence of SEQ ID NO: 1101 which consists of the light chain variable region of SEQ ID NO: 1102 linked to the light chain constant region of SEQ ID NO: 1110.

In another embodiment, the invention includes antibodies and antigen-binding fragments having binding specificity to PACAP that contain a light chain variable region sequence comprising the sequence set forth below:

(SEQ ID NO: 1102)
DIQMTQSPSTLSASVGDRVTITCLASQNIYNSLAWYQQKPGKAPK

LLIYRASTLASGVPSRFSGSGSGTEFTLTISSLQPDDFATYYCQQGAGAD

NIGNPFGGGTKVEIKR.

In another embodiment, the invention includes antibodies and antigen-binding fragments having binding specificity to PACAP, that bind the same epitope as Ab4.H, and that contain a light chain constant region sequence comprising the sequence set forth below:

(SEQ ID NO: 1110)
TVAAPSVFIFPPSDEQLKSGTASVVCLLNNFYPREAKVQWKVDNA

LQSGNSQESVTEQDSKDSTYSLSSTLTLSKADYEKHKVYACEVTHQGLSS

PVTKSFNRGEC.

In another embodiment, the invention includes antibodies and antigen-binding fragments having binding specificity to PACAP that contain one, two, or three of the polypeptide sequences of SEQ ID NO: 1084; SEQ ID NO: 1086; and SEQ ID NO: 1088, which correspond to the CDRs (hypervariable regions) of the heavy chain sequence of SEQ ID NO: 1081, or which contain the heavy chain variable region sequence of SEQ ID NO: 1082, and/or which further contain one, two, or three of the polypeptide sequences of SEQ ID NO: 1104; SEQ ID NO: 1106; and SEQ ID NO: 1108, which correspond to the CDRs (hypervariable regions) of the light chain sequence of SEQ ID NO: 1101, or which contain the light chain variable region sequence of SEQ ID NO: 1102, or antibodies or antigen-binding fragments containing combinations of sequences that are at least 80%, 85%, 90%, 95%, 96%, 97%, 98%, or 99% identical thereto. In another embodiment of the invention, the antibodies of the invention and antigen-binding fragments comprise, or alternatively consist of, combinations of one or more of the exemplified heavy chain variable region and light chain variable region sequences, or the heavy chain and light chain sequences set forth above, or sequences that are at least 90% or 95% identical thereto.

The invention further contemplates anti-PACAP antibodies and antigen-binding fragments comprising one, two, three, or four of the polypeptide sequences of SEQ ID NO: 1083; SEQ ID NO: 1085; SEQ ID NO: 1087; and SEQ ID NO: 1089, which correspond to the FRs (constant regions) of the heavy chain sequence of SEQ ID NO: 1081, or the heavy chain variable region sequence of SEQ ID NO: 1082, and/or one, two, three, or four of the polypeptide sequences of SEQ ID NO: 1103; SEQ ID NO: 1105; SEQ ID NO: 1107; and SEQ ID NO: 1109, which correspond to the FRs (constant regions) of the light chain sequence of SEQ ID NO: 1101, or the light chain variable region sequence of SEQ ID NO: 1102, or combinations of these polypeptide sequences, or sequences that are at least 80%, 90%, 95%, 96%, 97%, 98%, or 99% identical therewith.

In another embodiment of the invention, the anti-PACAP antibodies and antigen-binding fragments of the invention or fragments comprise, or alternatively consist of, combinations of one or more of the FRs, CDRs, the heavy chain variable region and light chain variable region sequences, and the heavy chain and light chain sequences set forth above, including all of them, or sequences that are at least 90% or 95% identical thereto.

In another embodiment of the invention, the anti-PACAP antibodies and antigen-binding fragments of the invention comprise, or alternatively consist of, the polypeptide sequence of SEQ ID NO: 1081, or SEQ ID NO: 1082, or polypeptides that are at least 90% or 95% identical thereto. In another embodiment of the invention, the antibodies and antigen-binding fragments of the invention comprise, or alternatively consist of, the polypeptide sequence of SEQ ID NO: 1101, or SEQ ID NO: 1102, or polypeptides that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 1084; SEQ ID NO: 1086; and SEQ ID NO: 1088, which correspond to the CDRs (hypervariable regions) of the heavy chain sequence of SEQ ID NO: 1081, or the heavy chain variable region sequence of SEQ ID NO: 1082, or sequences that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 1104; SEQ ID NO: 1106; and SEQ ID NO: 1108, which correspond to the CDRs (hypervariable regions) of the light chain sequence of SEQ ID NO: 1101, or the light chain variable region sequence of SEQ ID NO: 1102, or sequences that are at least 90% or 95% identical thereto.

In a further embodiment of the invention, the antibodies and antigen-binding fragments having binding specificity to PACAP comprise, or alternatively consist of, one, two, three, or four of the polypeptide sequences of SEQ ID NO: 1083; SEQ ID NO: 1085; SEQ ID NO: 1087; and SEQ ID NO: 1089, which correspond to the FRs (constant regions) of the heavy chain sequence of SEQ ID NO: 1081, or the variable heavy chain sequence of SEQ ID NO: 1082, or sequences that are at least 90% or 95% identical thereto.

In a further embodiment of the invention, the subject antibodies and antigen-binding fragments having binding specificity to PACAP comprise, or alternatively consist of, one, two, three, or four of the polypeptide sequences of SEQ ID NO: 1103; SEQ ID NO: 1105; SEQ ID NO: 1107; and SEQ ID NO: 1109, which correspond to the FRs (constant regions) of the light chain sequence of SEQ ID NO: 1101, or the variable light chain sequence of SEQ ID NO: 1102, or sequences that are at least 90% or 95% identical thereto.

The invention also contemplates anti-PACAP antibodies and antigen-binding fragments that include one or more of the antibody fragments described herein. In one embodiment of the invention, antibodies and antigen-binding fragments having binding specificity to PACAP comprise, or alternatively consist of, one, two, three, or more, including all of the following antibody fragments: the heavy chain variable region of SEQ ID NO: 1082; the region of SEQ ID NO: 1102; the complementarity determining regions (SEQ ID NO: 1084; SEQ ID NO: 1086; and SEQ ID NO: 1088) of the light chain variable region of SEQ ID NO: 1082; and the complementarity determining regions (SEQ ID NO: 1104; SEQ ID NO: 1106; and SEQ ID NO: 1108) of the light chain variable region of SEQ ID NO: 1102, or sequences that are at least 90% or 95% identical thereto. In another embodiment of the invention, fragments of the antibodies having binding specificity to PACAP comprise, or alternatively consist of, one, two, three, or more, including all of the following antibody fragments: the variable heavy chain region of SEQ ID NO: 1082; the variable light chain region of SEQ ID NO: 1102; the framework regions (SEQ ID NO: 1083; SEQ ID NO: 1085; SEQ ID NO: 1087; and SEQ ID NO: 1089) of the heavy chain variable region of SEQ ID NO: 1082; and the framework regions (SEQ ID NO: 1103; SEQ ID NO: 1105; SEQ ID NO: 1107; and SEQ ID NO: 1109) of the light chain variable region of SEQ ID NO: 1102, or sequences that are at least 90% or 95% identical thereto.

In another embodiment of the invention, the anti-PACAP antibody is Ab4.H, comprising, or alternatively consisting of, SEQ ID NO: 1081 and SEQ ID NO: 1101, or SEQ ID NO: 1082 and SEQ ID NO: 1102, or an antibody or antigen-binding fragment comprising the CDRs of Ab4.H and having at least one of the biological activities set forth herein, or is an anti-PACAP antibody that competes with Ab4.H in binding PACAP, preferably one containing sequences that are at least 90%, 95%, 96%, 97%, 98%, or 99% identical to that of Ab4.H, or an antibody that binds to the same or overlapping epitope(s) on PACAP as Ab4.H.

In a further embodiment of the invention, antigen-binding fragments comprise, or alternatively consist of, Fab fragments having binding specificity for PACAP. With respect to antibody Ab4.H, the Fab fragment preferably includes the heavy chain variable region sequence of SEQ ID NO: 1082 and the light chain variable region sequence of SEQ ID NO: 1102, or sequences that are at least 90%, 95%, 96%, 97%, 98%, or 99% identical thereto. This embodiment of the invention further includes Fabs containing additions, deletions, and variants of SEQ ID NO: 1082 and/or SEQ ID NO: 1102 that retain the binding specificity for PACAP.

In one embodiment of the invention described herein, Fab fragments may be produced by enzymatic digestion (e.g., papain) of Ab4.H. In another embodiment of the invention, anti-PACAP antibodies such as Ab4.H and Fab fragments may be produced via expression in mammalian cells, such as CHO, NSO, or HEK 293 cells, fungal, insect, or microbial systems, such as yeast cells (for example haploid or diploid yeast, such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PACAP, including the heavy and/or light chains of Ab4.H, as well as fragments, variants, and combinations of one or more of the FRs, CDRs, the heavy chain variable region and light chain variable region sequences, and the heavy chain and light chain sequences set forth above, including all of them, or sequences that are at least 90% or 95% identical thereto.

Antibody Ab5.H

In one embodiment, the invention includes antibodies and antigen-binding fragments having binding specificity to PACAP that possess a heavy chain sequence comprising the sequence of SEQ ID NO: 1001 which consists of the heavy chain variable region of SEQ ID NO: 1002 linked to the heavy chain constant region of SEQ ID NO: 1010.

In one embodiment, the invention includes antibodies and antigen-binding fragments having binding specificity to PACAP that contain a heavy chain variable region sequence comprising the sequence set forth below:

```
                                            (SEQ ID NO: 1002)
EVQLVESGGGLVQPGGSLRLSCAASGFSLSSYAMIWVRQAPGKGL

EWVGIIYDNGDTYYASSAKGRFTISRDNSKNTVYLQMNSLRAEDTAVYFC

AREPGSTTQNDLWGQGTLVTVSS.
```

In another embodiment, the invention includes antibodies and antigen-binding fragments having binding specificity to PACAP that bind the same epitope as Ab5.H, and that contain a heavy chain constant region sequence comprising the polypeptide of SEQ ID NO: 1244, 1245, or 1246, or comprising the sequence set forth below:

```
                                            (SEQ ID NO: 1010)
ASTKGPSVFPLAPSSKSTSGGTAALGCLVKDYFPEPVTVSWNSGA

LTSGVHTFPAVLQSSGLYSLSSVVTVPSSSLGTQTYICNVNHKPSNTKVD

KKVEPKSCDKTHTCPPCPAPELLGGPSVFLFPPKPKDTLMISRTPEVTCV

VVDVSHEDPEVKFNWYVDGVEVHNAKTKPREEQYASTYRVVSVLTVLHQD

WLNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLTV

DKSRWQQGNVFSCSVMHEALHNHYTQKSLSLSPGK.
```

In another embodiment, the invention includes antibodies and antigen-binding fragments having binding specificity to PACAP that contain a light chain sequence comprising the sequence of SEQ ID NO: 1021 which consists of the light chain variable region of SEQ ID NO: 1022 linked to the light chain constant region of SEQ ID NO: 1030.

In another embodiment, the invention includes antibodies and antigen-binding fragments having binding specificity to PACAP that contain a light chain variable region sequence comprising the sequence set forth below:

```
                                            (SEQ ID NO: 1022)
DVQMTQSPSTLSASVGDRVTITCQASENIYNSLLWYQQKPGKAPK

LLIYRASTLASGVPSRFSGSGSGTEFTLTISSLQPDDFATYYCQNYYNIW

TNGAAFGGGTKVEIKR.
```

In another embodiment, the invention includes antibodies and antigen-binding fragments having binding specificity to PACAP, that bind the same epitope as Ab5.H, and that contain a light chain constant region sequence comprising the sequence set forth below:

```
                                            (SEQ ID NO: 1030)
TVAAPSVFIFPPSDEQLKSGTASVVCLLNNFYPREAKVQWKVDNA

LQSGNSQESVTEQDSKDSTYSLSSTLTLSKADYEKHKVYACEVTHQGLSS

PVTKSFNRGEC.
```

In another embodiment, the invention includes antibodies and antigen-binding fragments having binding specificity to PACAP that contain one, two, or three of the polypeptide sequences of SEQ ID NO: 1004; SEQ ID NO: 1006; and SEQ ID NO: 1008, which correspond to the CDRs (hypervariable regions) of the heavy chain sequence of SEQ ID NO: 1001, or which contain the heavy chain variable region sequence of SEQ ID NO: 1002, and/or which further contain one, two, or three of the polypeptide sequences of SEQ ID NO: 1024; SEQ ID NO: 1026; and SEQ ID NO: 1028, which correspond to the CDRs (hypervariable regions) of the light chain sequence of SEQ ID NO: 1021, or which contain the light chain variable region sequence of SEQ ID NO: 1022, or antibodies or antigen-binding fragments containing combinations of sequences that are at least 80%, 85%, 90%, 95%, 96%, 97%, 98%, or 99% identical thereto. In another embodiment of the invention, the antibodies of the invention and antigen-binding fragments comprise, or alternatively consist of, combinations of one or more of the exemplified heavy chain variable region and light chain variable region sequences, or the heavy chain and light chain sequences set forth above, or sequences that are at least 90% or 95% identical thereto.

The invention further contemplates anti-PACAP antibodies and antigen-binding fragments comprising one, two, three, or four of the polypeptide sequences of SEQ ID NO: 1003; SEQ ID NO: 1005; SEQ ID NO: 1007; and SEQ ID NO: 1009, which correspond to the FRs (constant regions) of the heavy chain sequence of SEQ ID NO: 1001, or the heavy chain variable region sequence of SEQ ID NO: 1002, and/or one, two, three, or four of the polypeptide sequences of SEQ ID NO: 1023; SEQ ID NO: 1025; SEQ ID NO: 1027; and SEQ ID NO: 1029, which correspond to the FRs (constant regions) of the light chain sequence of SEQ ID NO: 1021, or the light chain variable region sequence of SEQ ID NO: 1022, or combinations of these polypeptide sequences, or sequences that are at least 80%, 90%, 95%, 96%, 97%, 98%, or 99% identical therewith.

In another embodiment of the invention, the anti-PACAP antibodies and antigen-binding fragments of the invention or fragments comprise, or alternatively consist of, combinations of one or more of the FRs, CDRs, the heavy chain variable region and light chain variable region sequences, and the heavy chain and light chain sequences set forth above, including all of them, or sequences that are at least 90% or 95% identical thereto.

In another embodiment of the invention, the anti-PACAP antibodies and antigen-binding fragments of the invention comprise, or alternatively consist of, the polypeptide sequence of SEQ ID NO: 1001, or SEQ ID NO: 1002, or polypeptides that are at least 90% or 95% identical thereto. In another embodiment of the invention, the antibodies and antigen-binding fragments of the invention comprise, or alternatively consist of, the polypeptide sequence of SEQ ID NO: 1021, or SEQ ID NO: 1022, or polypeptides that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 1004; SEQ ID NO: 1006; and SEQ ID NO: 1008, which correspond to the CDRs (hypervariable regions) of the heavy chain sequence of SEQ ID NO: 1001, or the heavy chain variable region sequence of SEQ ID NO: 1002, or sequences that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 1024; SEQ ID NO: 1026; and SEQ ID NO: 1028, which correspond to the CDRs (hypervariable regions) of the light chain sequence of SEQ ID NO: 1021, or the light chain variable region sequence of SEQ ID NO: 1022, or sequences that are at least 90% or 95% identical thereto.

In a further embodiment of the invention, the antibodies and antigen-binding fragments having binding specificity to PACAP comprise, or alternatively consist of, one, two, three, or four of the polypeptide sequences of SEQ ID NO: 1003; SEQ ID NO: 1005; SEQ ID NO: 1007; and SEQ ID NO: 1009, which correspond to the FRs (constant regions) of the heavy chain sequence of SEQ ID NO: 1001, or the heavy chain variable region sequence of SEQ ID NO: 1002, or sequences that are at least 90% or 95% identical thereto.

In a further embodiment of the invention, the subject antibodies and antigen-binding fragments having binding specificity to PACAP comprise, or alternatively consist of, one, two, three, or four of the polypeptide sequences of SEQ ID NO: 1023; SEQ ID NO: 1025; SEQ ID NO: 1027; and SEQ ID NO: 1029, which correspond to the FRs (constant regions) of the light chain sequence of SEQ ID NO: 1021, or the light chain variable region sequence of SEQ ID NO: 1022, or sequences that are at least 90% or 95% identical thereto.

The invention also contemplates anti-PACAP antibodies and antigen-binding fragments that include one or more of the antibody fragments described herein. In one embodiment of the invention, antibodies and antigen-binding fragments having binding specificity to PACAP comprise, or alternatively consist of, one, two, three, or more, including all of the following antibody fragments: the variable heavy chain region of SEQ ID NO: 1002; the variable light chain region of SEQ ID NO: 1022; the complementarity determining regions (SEQ ID NO: 1004; SEQ ID NO: 1006; and SEQ ID NO: 1008) of the heavy chain variable region of SEQ ID NO: 1002; and the complementarity determining regions (SEQ ID NO: 1024; SEQ ID NO: 1026; and SEQ ID NO: 1028) of the light chain variable region of SEQ ID NO: 1022, or sequences that are at least 90% or 95% identical thereto. In another embodiment of the invention, fragments of the antibodies having binding specificity to PACAP comprise, or alternatively consist of, one, two, three, or more, including all of the following antibody fragments: the heavy chain variable region of SEQ ID NO: 1002; the light chain variable region of SEQ ID NO: 1022; the framework regions (SEQ ID NO: 1003; SEQ ID NO: 1005; SEQ ID NO: 1007; and SEQ ID NO: 1009) of the heavy chain variable region of SEQ ID NO: 1002; and the framework regions (SEQ ID NO: 1023; SEQ ID NO: 1025; SEQ ID NO: 1027; and SEQ ID NO: 1029) of the light chain variable region of SEQ ID NO: 1022, or sequences that are at least 90% or 95% identical thereto.

In another embodiment of the invention, the anti-PACAP antibody is Ab5.H, comprising, or alternatively consisting of, SEQ ID NO: 1001 and SEQ ID NO: 1021, or SEQ ID NO: 1002 and SEQ ID NO: 1022, or an antibody or antigen-binding fragment comprising the CDRs of Ab5.H and having at least one of the biological activities set forth herein, or is an anti-PACAP antibody that competes with Ab5.H in binding PACAP, preferably one containing sequences that are at least 90%, 95%, 96%, 97%, 98%, or 99% identical to that of Ab5.H, or an antibody that binds to the same or overlapping epitope(s) on PACAP as Ab5.H.

In a further embodiment of the invention, antigen-binding fragments comprise, or alternatively consist of, Fab fragments having binding specificity for PACAP. With respect to antibody Ab5.H, the Fab fragment preferably includes the heavy chain variable region sequence of SEQ ID NO: 1002 and the light chain variable region sequence of SEQ ID NO: 1022, or sequences that are at least 90%, 95%, 96%, 97%, 98%, or 99% identical thereto. This embodiment of the invention further includes Fabs containing additions, deletions, and variants of SEQ ID NO: 1002 and/or SEQ ID NO: 1022 that retain the binding specificity for PACAP.

In one embodiment of the invention described herein, Fab fragments may be produced by enzymatic digestion (e.g., papain) of Ab5.H. In another embodiment of the invention, anti-PACAP antibodies such as Ab5.H and Fab fragments may be produced via expression in mammalian cells, such as CHO, NSO, or HEK 293 cells, fungal, insect, or microbial systems, such as yeast cells (for example haploid or diploid yeast, such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PACAP, including the heavy and/or light chains of Ab5.H, as well as fragments, variants, and combinations of one or more of the FRs, CDRs, the heavy chain variable region and light chain variable region sequences, and the heavy chain and light chain sequences set forth above, including all of them, or sequences that are at least 90% or 95% identical thereto.

Antibody Ab9

In one embodiment, the invention includes antibodies and antigen-binding fragments having binding specificity to PACAP that possess a heavy chain sequence comprising the sequence of SEQ ID NO: 801 which consists of the heavy chain variable region of SEQ ID NO: 802 linked to the heavy chain constant region of SEQ ID NO: 810.

In one embodiment, the invention includes antibodies and antigen-binding fragments having binding specificity to PACAP that contain a heavy chain variable region sequence comprising the sequence set forth below:

(SEQ ID NO: 802)
QQLEQSGGGAEGGLVKPGGSLKLSCKASGFTISRDYWICWVRQAP

GKGLEWIGCISAGGGSTDYANWVNGRFTLSRDIDQSTGCLQLNSLTDADT

AMYYCAGNLEIWGQGTLVTVSS.

In another embodiment, the invention includes antibodies and antigen-binding fragments having binding specificity to PACAP that bind the same epitope as Ab9, and that contain a heavy chain constant region sequence comprising the polypeptide of SEQ ID NO: 1244, 1245, or 1246, or comprising the sequence set forth below:

(SEQ ID NO: 810)
ASTKGPSVFPLAPSSKSTSGGTAALGCLVKDYFPEPVTVSWNSGA

LTSGVHTFPAVLQSSGLYSLSSVVTVPSSSLGTQTYICNVNHKPSNTKVD

ARVEPKSCDKTHTCPPCPAPELLGGPSVFLFPPKPKDTLMISRTPEVTCV

VVDVSHEDPEVKFNWYVDGVEVHNAKTKPREEQYASTYRVVSVLTVLHQD

WLNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLTV

DKSRWQQGNVFSCSVMHEALHNHYTQKSLSLSPGK.

In another embodiment, the invention includes antibodies and antigen-binding fragments having binding specificity to PACAP that contain a light chain sequence comprising the sequence of SEQ ID NO: 821 which consists of the light chain variable region of SEQ ID NO: 822 linked to the light chain constant region of SEQ ID NO: 830.

In another embodiment, the invention includes antibodies and antigen-binding fragments having binding specificity to PACAP that contain a light chain variable region sequence comprising the sequence set forth below:

(SEQ ID NO: 822)
AQVLTQTPSSVSAAVGGTVTINCQSSPSIYSGAFLSWFQQKPGQP

PKFLIYEASKLASGVPSRFSGSGSGTQFTLTISDVQCDDAATYYCLGFYD

CSSVDCHAFGGGTEVVVKR.

In another embodiment, the invention includes antibodies and antigen-binding fragments having binding specificity to PACAP, that bind the same epitope as Ab9, and that contain a light chain constant region sequence comprising the sequence set forth below:

(SEQ ID NO: 830)
TVAAPSVFIFPPSDEQLKSGTASVVCLLNNFYPREAKVQWKVDNA

LQSGNSQESVTEQDSKDSTYSLSSTLTLSKADYEKHKVYACEVTHQGLSS

PVTKSFNRGEC.

In another embodiment, the invention includes antibodies and antigen-binding fragments having binding specificity to PACAP that contain one, two, or three of the polypeptide sequences of SEQ ID NO: 804; SEQ ID NO: 806; and SEQ ID NO: 808, which correspond to the CDRs (hypervariable regions) of the heavy chain sequence of SEQ ID NO: 801, or which contain the heavy chain variable region sequence of SEQ ID NO: 802, and/or which further contain one, two, or three of the polypeptide sequences of SEQ ID NO: 824; SEQ ID NO: 826; and SEQ ID NO: 828, which correspond to the CDRs (hypervariable regions) of the light chain sequence of SEQ ID NO: 821, or which contain the light chain variable region sequence of SEQ ID NO: 822, or antibodies or antigen-binding fragments containing combinations of sequences that are at least 80%, 85%, 90%, 95%, 96%, 97%, 98%, or 99% identical thereto. In another embodiment of the invention, the antibodies of the invention and antigen-binding fragments comprise, or alternatively consist of, combinations of one or more of the exemplified heavy chain variable region and light chain variable region sequences, or the heavy chain and light chain sequences set forth above, or sequences that are at least 90% or 95% identical thereto.

The invention further contemplates anti-PACAP antibodies and antigen-binding fragments comprising one, two, three, or four of the polypeptide sequences of SEQ ID NO: 803; SEQ ID NO: 805; SEQ ID NO: 807; and SEQ ID NO: 809, which correspond to the FRs (constant regions) of the heavy chain sequence of SEQ ID NO: 801, or the heavy chain variable region sequence of SEQ ID NO: 802, and/or one, two, three, or four of the polypeptide sequences of SEQ ID NO: 823; SEQ ID NO: 825; SEQ ID NO: 827; and SEQ ID NO: 829, which correspond to the FRs (constant regions) of the light chain sequence of SEQ ID NO: 821, or the light chain variable region sequence of SEQ ID NO: 822, or combinations of these polypeptide sequences, or sequences that are at least 80%, 90%, 95%, 96%, 97%, 98%, or 99% identical therewith.

In another embodiment of the invention, the anti-PACAP antibodies and antigen-binding fragments of the invention or fragments comprise, or alternatively consist of, combinations of one or more of the FRs, CDRs, the heavy chain variable region and light chain variable region sequences, and the heavy chain and light chain sequences set forth above, including all of them, or sequences that are at least 90% or 95% identical thereto.

In another embodiment of the invention, the anti-PACAP antibodies and antigen-binding fragments of the invention comprise, or alternatively consist of, the polypeptide sequence of SEQ ID NO: 801, or SEQ ID NO: 802, or polypeptides that are at least 90% or 95% identical thereto. In another embodiment of the invention, the antibodies and antigen-binding fragments of the invention comprise, or alternatively consist of, the polypeptide sequence of SEQ ID NO: 821, or SEQ ID NO: 822, or polypeptides that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 804; SEQ ID NO: 806; and SEQ ID NO: 808, which correspond to the CDRs (hypervariable regions) of the heavy chain sequence of SEQ ID NO: 801, or the heavy chain variable region sequence of SEQ ID NO: 802, or sequences that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 824; SEQ ID NO: 826; and SEQ ID NO: 828, which correspond to the CDRs (hypervariable regions) of the light chain sequence of SEQ ID NO: 821, or the light chain variable region sequence of SEQ ID NO: 822, or sequences that are at least 90% or 95% identical thereto.

In a further embodiment of the invention, the antibodies and antigen-binding fragments having binding specificity to PACAP comprise, or alternatively consist of, one, two, three, or four of the polypeptide sequences of SEQ ID NO: 803; SEQ ID NO: 805; SEQ ID NO: 807; and SEQ ID NO: 809, which correspond to the FRs (constant regions) of the heavy chain sequence of SEQ ID NO: 801, or the heavy chain variable region sequence of SEQ ID NO: 802, or sequences that are at least 90% or 95% identical thereto.

In a further embodiment of the invention, the subject antibodies and antigen-binding fragments having binding specificity to PACAP comprise, or alternatively consist of, one, two, three, or four of the polypeptide sequences of SEQ ID NO: 823; SEQ ID NO: 825; SEQ ID NO: 827; and SEQ ID NO: 829, which correspond to the FRs (constant regions) of the light chain sequence of SEQ ID NO: 821, or the light chain variable region sequence of SEQ ID NO: 822, or sequences that are at least 90% or 95% identical thereto.

The invention also contemplates anti-PACAP antibodies and antigen-binding fragments that include one or more of the antibody fragments described herein. In one embodiment of the invention, antibodies and antigen-binding fragments having binding specificity to PACAP comprise, or alternatively consist of, one, two, three, or more, including all of the following antibody fragments: the heavy chain variable region of SEQ ID NO: 802; the light chain variable region of SEQ ID NO: 822; the complementarity determining regions (SEQ ID NO: 804; SEQ ID NO: 806; and SEQ ID NO: 808) of the heavy chain variable region of SEQ ID NO: 802; and the complementarity determining regions (SEQ ID NO: 824; SEQ ID NO: 826; and SEQ ID NO: 828) of the light chain variable region of SEQ ID NO: 822, or sequences that are at least 90% or 95% identical thereto. In another embodiment of the invention, fragments of the antibodies having binding specificity to PACAP comprise, or alternatively consist of, one, two, three, or more, including all of the following antibody fragments: the heavy chain variable region of SEQ ID NO: 802; the light chain variable region of SEQ ID NO: 822; the framework regions (SEQ ID NO: 803; SEQ ID NO: 805; SEQ ID NO: 807; and SEQ ID NO: 809) of the heavy chain variable region of SEQ ID NO: 802; and the framework regions (SEQ ID NO: 823; SEQ ID NO: 825; SEQ ID NO: 827; and SEQ ID NO: 829) of the light chain variable region of SEQ ID NO: 822, or sequences that are at least 90% or 95% identical thereto.

In another embodiment of the invention, the anti-PACAP antibody is Ab9, comprising, or alternatively consisting of, SEQ ID NO: 801 and SEQ ID NO: 821, or SEQ ID NO: 802 and SEQ ID NO: 822, or an antibody or antigen-binding fragment comprising the CDRs of Ab9 and having at least one of the biological activities set forth herein, or is an anti-PACAP antibody that competes with Ab9 in binding PACAP, preferably one containing sequences that are at least 90%, 95%, 96%, 97%, 98%, or 99% identical to that of Ab9, or an antibody that binds to the same or overlapping epitope(s) on PACAP as Ab9.

In a further embodiment of the invention, antigen-binding fragments comprise, or alternatively consist of, Fab fragments having binding specificity for PACAP. With respect to antibody Ab9, the Fab fragment preferably includes the heavy chain variable region sequence of SEQ ID NO: 802 and the light chain variable region sequence of SEQ ID NO: 822, or sequences that are at least 90%, 95%, 96%, 97%, 98%, or 99% identical thereto. This embodiment of the invention further includes Fabs containing additions, deletions, and variants of SEQ ID NO: 802 and/or SEQ ID NO: 822 that retain the binding specificity for PACAP.

In one embodiment of the invention described herein, Fab fragments may be produced by enzymatic digestion (e.g., papain) of Ab9. In another embodiment of the invention, anti-PACAP antibodies such as Ab9 and Fab fragments may be produced via expression in mammalian cells, such as CHO, NSO, or HEK 293 cells, fungal, insect, or microbial systems, such as yeast cells (for example haploid or diploid yeast, such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PACAP, including the heavy and/or light chains of Ab9, as well as fragments, variants, and combinations of one or more of the FRs, CDRs, the heavy chain variable region and light chain variable region sequences, and the heavy chain and light chain sequences set forth above, including all of them, or sequences that are at least 90% or 95% identical thereto.

Antibody Ab9.H

In one embodiment, the invention includes antibodies and antigen-binding fragments having binding specificity to PACAP that possess a heavy chain sequence comprising the sequence of SEQ ID NO: 1161 which consists of the heavy chain variable region of SEQ ID NO: 1162 linked to the heavy chain constant region of SEQ ID NO: 1170.

In one embodiment, the invention includes antibodies and antigen-binding fragments having binding specificity to PACAP that contain a heavy chain variable region sequence comprising the sequence set forth below:

(SEQ ID NO: 1162)
EVQLVESGGGLVQPGGSLRLSCAASGFTVSRDYWICWVRQAPGKG

LEWIGCISAGGGSTDYANWVNGRFTISRDISKNTGYLQMNSLRAEDTAVY

YCAGNLEIWGQGTLVTVSS.

In another embodiment, the invention includes antibodies and antigen-binding fragments having binding specificity to PACAP that bind the same epitope as Ab9.H, and that contain a heavy chain constant region sequence comprising the polypeptide of SEQ ID NO: 1244, 1245, or 1246, or comprising the sequence set forth below:

(SEQ ID NO: 1170)
ASTKGPSVFPLAPSSKSTSGGTAALGCLVKDYFPEPVTVSWNSGA

LTSGVHTFPAVLQSSGLYSLSSVVTVPSSSLGTQTYICNVNHKPSNTKVD

KKVEPKSCDKTHTCPPCPAPELLGGPSVFLFPPKPKDTLMISRTPEVTCV

VVDVSHEDPEVKFNWYVDGVEVHNAKTKPREEQYASTYRVVSVLTVLHQD

WLNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLTV

DKSRWQQGNVFSCSVMHEALHNHYTQKSLSLSPGK.

In another embodiment, the invention includes antibodies and antigen-binding fragments having binding specificity to PACAP that contain a light chain sequence comprising the sequence of SEQ ID NO: 1181 which consists of the light chain variable region of SEQ ID NO: 1182 linked to the light chain constant region of SEQ ID NO: 1190.

In another embodiment, the invention includes antibodies and antigen-binding fragments having binding specificity to PACAP that contain a light chain variable region sequence comprising the sequence set forth below:

(SEQ ID NO: 1182)
DIQMTQSPSTLSASVGDRVTITCQSSPSIYSGAFLSWYQQKPGKAPKFLI

YEASKLASGVPSRFSGSGSGTEFTLTISSLQPDDFATYYCLGFYDCSSVD

CHAFGGGTKVEIKR.

In another embodiment, the invention includes antibodies and antigen-binding fragments having binding specificity to PACAP, that bind the same epitope as Ab9.H, and that contain a light chain constant region sequence comprising the sequence set forth below:

(SEQ ID NO: 1190)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antigen-binding fragments having binding specificity to PACAP that contain one, two, or three of the polypeptide sequences of SEQ ID NO: 1164; SEQ ID NO: 1166; and SEQ ID NO: 1168, which correspond to the CDRs (hypervariable regions) of the heavy chain sequence of SEQ ID NO: 1161, or which contain the heavy chain variable region sequence of SEQ ID NO: 1162, and/or which further contain one, two, or three of the polypeptide sequences of SEQ ID NO: 1184; SEQ ID NO: 1186; and SEQ ID NO: 1188, which correspond to the CDRs (hypervariable regions) of the light chain sequence of SEQ ID NO: 1181, or which contain the light chain variable region sequence of SEQ ID NO: 1182, or antibodies or antigen-binding fragments containing combinations of sequences that are at least 80%, 85%, 90%, 95%, 96%, 97%, 98%, or 99% identical thereto. In another embodiment of the invention, the antibodies of the invention and antigen-binding fragments comprise, or alternatively consist of, combinations of one or more of the exemplified heavy chain variable region and light chain variable region sequences, or the heavy chain and light chain sequences set forth above, or sequences that are at least 90% or 95% identical thereto.

The invention further contemplates anti-PACAP antibodies and antigen-binding fragments comprising one, two, three, or four of the polypeptide sequences of SEQ ID NO: 1163; SEQ ID NO: 1165; SEQ ID NO: 1167; and SEQ ID NO: 1169, which correspond to the FRs (constant regions) of the heavy chain sequence of SEQ ID NO: 1161, or the heavy chain variable region sequence of SEQ ID NO: 1162, and/or one, two, three, or four of the polypeptide sequences of SEQ ID NO: 1183; SEQ ID NO: 1185; SEQ ID NO: 1187; and SEQ ID NO: 1189, which correspond to the FRs (constant regions) of the light chain sequence of SEQ ID NO: 1181, or the light chain variable region sequence of SEQ ID NO: 1182, or combinations of these polypeptide sequences, or sequences that are at least 80%, 90%, 95%, 96%, 97%, 98%, or 99% identical therewith.

In another embodiment of the invention, the anti-PACAP antibodies and antigen-binding fragments of the invention or fragments comprise, or alternatively consist of, combinations of one or more of the FRs, CDRs, the heavy chain variable region and light chain variable region sequences, and the heavy chain and light chain sequences set forth above, including all of them, or sequences that are at least 90% or 95% identical thereto.

In another embodiment of the invention, the anti-PACAP antibodies and antigen-binding fragments of the invention comprise, or alternatively consist of, the polypeptide sequence of SEQ ID NO: 1161, or SEQ ID NO: 1162, or polypeptides that are at least 90% or 95% identical thereto. In another embodiment of the invention, the antibodies and antigen-binding fragments of the invention comprise, or alternatively consist of, the polypeptide sequence of SEQ ID NO: 1181, or SEQ ID NO: 1182, or polypeptides that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 1164; SEQ ID NO: 1166; and SEQ ID NO: 1168, which correspond to the CDRs (hypervariable regions) of the heavy chain sequence of SEQ ID NO: 1161, or the heavy chain variable region sequence of SEQ ID NO: 1162, or sequences that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 1184; SEQ ID NO: 1186; and SEQ ID NO: 1188, which correspond to the CDRs (hypervariable regions) of the light chain sequence of SEQ ID NO: 1181, or the light chain variable region sequence of SEQ ID NO: 1182, or sequences that are at least 90% or 95% identical thereto.

In a further embodiment of the invention, the antibodies and antigen-binding fragments having binding specificity to PACAP comprise, or alternatively consist of, one, two, three, or four of the polypeptide sequences of SEQ ID NO: 1163; SEQ ID NO: 1165; SEQ ID NO: 1167; and SEQ ID NO: 1169, which correspond to the FRs (constant regions) of the heavy chain sequence of SEQ ID NO: 1161, or the heavy chain variable region sequence of SEQ ID NO: 1162, or sequences that are at least 90% or 95% identical thereto.

In a further embodiment of the invention, the subject antibodies and antigen-binding fragments having binding specificity to PACAP comprise, or alternatively consist of, one, two, three, or four of the polypeptide sequences of SEQ ID NO: 1183; SEQ ID NO: 1185; SEQ ID NO: 1187; and SEQ ID NO: 1189, which correspond to the FRs (constant regions) of the light chain sequence of SEQ ID NO: 1181, or the light chain variable region sequence of SEQ ID NO: 1182, or sequences that are at least 90% or 95% identical thereto.

The invention also contemplates anti-PACAP antibodies and antigen-binding fragments that include one or more of the antibody fragments described herein. In one embodiment of the invention, antibodies and antigen-binding fragments having binding specificity to PACAP comprise, or alternatively consist of, one, two, three, or more, including all of the following antibody fragments: the heavy chain variable region of SEQ ID NO: 1162; the light chain variable region of SEQ ID NO: 1182; the complementarity determining regions (SEQ ID NO: 1164; SEQ ID NO: 1166; and SEQ ID NO: 1168) of the heavy chain variable region of SEQ ID NO: 1162; and the complementarity determining regions (SEQ ID NO: 1184; SEQ ID NO: 1186; and SEQ ID NO: 1188) of the light chain variable region of SEQ ID NO: 1182, or sequences that are at least 90% or 95% identical thereto. In another embodiment of the invention, fragments of the antibodies having binding specificity to PACAP comprise, or alternatively consist of, one, two, three, or more, including all of the following antibody fragments: the heavy chain variable region of SEQ ID NO: 1162; the light chain variable region of SEQ ID NO: 1182; the framework regions (SEQ ID NO: 1163; SEQ ID NO: 1165; SEQ ID NO: 1167; and SEQ ID NO: 1169) of the heavy chain variable region of SEQ ID NO: 1162; and the framework regions (SEQ ID NO: 1183; SEQ ID NO: 1185; SEQ ID NO: 1187; and SEQ ID NO: 1189) of the light chain variable region of SEQ ID NO: 1182, or sequences that are at least 90% or 95% identical thereto.

In another embodiment of the invention, the anti-PACAP antibody is Ab9.H, comprising, or alternatively consisting of, SEQ ID NO: 1161 and SEQ ID NO: 1181, or SEQ ID NO: 1162 and SEQ ID NO: 1182, or an antibody or antigen-binding fragment comprising the CDRs of Ab9.H and having at least one of the biological activities set forth herein, or is an anti-PACAP antibody that competes with Ab9.H in binding PACAP, preferably one containing sequences that are at least 90%, 95%, 96%, 97%, 98%, or 99% identical to that of Ab9.H, or an antibody that binds to the same or overlapping epitope(s) on PACAP as Ab9.H.

In a further embodiment of the invention, antigen-binding fragments comprise, or alternatively consist of, Fab fragments having binding specificity for PACAP. With respect to antibody Ab9.H, the Fab fragment preferably includes the heavy chain variable region sequence of SEQ ID NO: 1162 and the light chain variable region sequence of SEQ ID NO: 1182, or sequences that are at least 90%, 95%, 96%, 97%, 98%, or 99% identical thereto. This embodiment of the invention further includes Fabs containing additions, deletions, and variants of SEQ ID NO: 1162 and/or SEQ ID NO: 1182 that retain the binding specificity for PACAP.

In one embodiment of the invention described herein, Fab fragments may be produced by enzymatic digestion (e.g., papain) of Ab9.H. In another embodiment of the invention, anti-PACAP antibodies such as Ab9.H and Fab fragments may be produced via expression in mammalian cells, such as CHO, NSO, or HEK 293 cells, fungal, insect, or microbial systems, such as yeast cells (for example haploid or diploid yeast, such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PACAP, including the heavy and/or light chains of Ab9.H, as well as fragments, variants, and combinations of one or more of the FRs, CDRs, the heavy chain variable region and light chain variable region sequences, and the heavy chain and light chain sequences set forth above, including all of them, or sequences that are at least 90% or 95% identical thereto.

Antibody Ab12.H

In one embodiment, the invention includes antibodies and antigen-binding fragments having binding specificity to PACAP that possess a heavy chain sequence comprising the sequence of SEQ ID NO: 1041 which consists of the heavy chain variable region of SEQ ID NO: 1042 linked to the heavy chain constant region of SEQ ID NO: 1050.

In one embodiment, the invention includes antibodies and antigen-binding fragments having binding specificity to PACAP that contain a heavy chain variable region sequence comprising the sequence set forth below:

(SEQ ID NO: 1042)
EVQLVESGGGLVQPGGSLRLSCAASGFSLSSYAMGWVRQAPGKGLEWIGDI

STYGTTDYASWVYGRFTISRDNSKNTVYLQMNSLRAEDTAVYFCARDYWLS

LWGQGTLVTVSS.

In another embodiment, the invention includes antibodies and antigen-binding fragments having binding specificity to PACAP that bind the same epitope as Ab12.H, and that contain a heavy chain constant region sequence comprising the polypeptide of SEQ ID NO: 1244, 1245, or 1246, or comprising the sequence set forth below:

(SEQ ID NO: 1050)
ASTKGPSVFPLAPSSKSTSGGTAALGCLVKDYFPEPVTVSWNSGALTSGVH

TFPAVLQSSGLYSLSSVVTVPSSSLGTQTYICNVNHKPSNTKVDKKVCEKS

CDKTHTCPPCPAPELLGGPSVFLFPPKPKDTLMISRTPCVTCVVVDVSHED

PEVKFNWYVDGVCVHNAKTKPREEQYASTYRVVSVLTVLHQDWLNGKEYKC

KVSNKALPAPICKTISKAKGQPREPQVYTLPPSREEMTKNQVSLTCLVKGF

YPSDIAVCWESNGQPENNYKTTPPVLDSDGSFFLYSKLTVDKSRWQQGNVF

SCSVMHEALHNHYTQKSLSLSPGK.

In another embodiment, the invention includes antibodies and antigen-binding fragments having binding specificity to PACAP that contain a light chain sequence comprising the sequence of SEQ ID NO: 1061 which consists of the light chain variable region of SEQ ID NO: 1062 linked to the light chain constant region of SEQ ID NO: 1070.

In another embodiment, the invention includes antibodies and antigen-binding fragments having binding specificity to PACAP that contain a light chain variable region sequence comprising the sequence set forth below:

(SEQ ID NO: 1062)
AAQLTQSPSTLSASVGDRVTITCQSSQSVYDNNALAWYQQKPGKAPKLLIY

AASTLASGVPSRFSGSGSGTEFTLTISSLQPDDFATYYCLGGYYDPADNAF

GGGTKVEIKR.

In another embodiment, the invention includes antibodies and antigen-binding fragments having binding specificity to PACAP, that bind the same epitope as Ab12.H, and that contain a light chain constant region sequence comprising the sequence set forth below:

(SEQ ID NO: 1070)
TVAAPSVFIFPPSDEQLKSGTASVVCLLNNFYPREAKVQWKVDNALQSGNS

QESVTEQDSKDSTYSLSSTLTLSKADYEKHKVYACEVTHQGLSSPVTKSFN

RGEC.

In another embodiment, the invention includes antibodies and antigen-binding fragments having binding specificity to PACAP that contain one, two, or three of the polypeptide sequences of SEQ ID NO: 1044; SEQ ID NO: 1046; and SEQ ID NO: 1048, which correspond to the CDRs (hypervariable regions) of the heavy chain sequence of SEQ ID NO: 1041, or which contain the heavy chain variable region sequence of SEQ ID NO: 1042, and/or which further contain one, two, or three of the polypeptide sequences of SEQ ID NO: 1064; SEQ ID NO: 1066; and SEQ ID NO: 1068, which correspond to the CDRs (hypervariable regions) of the light chain sequence of SEQ ID NO: 1061, or which contain the light chain variable region sequence of SEQ ID NO: 1062, or antibodies or antigen-binding fragments containing combinations of sequences that are at least 80%, 85%, 90%, 95%, 96%, 97%, 98%, or 99% identical thereto. In another embodiment of the invention, the antibodies of the invention and antigen-binding fragments comprise, or alternatively consist of, combinations of one or more of the exemplified heavy chain variable region and light chain variable region sequences, or the heavy chain and light chain sequences set forth above, or sequences that are at least 90% or 95% identical thereto.

The invention further contemplates anti-PACAP antibodies and antigen-binding fragments comprising one, two, three, or four of the polypeptide sequences of SEQ ID NO: 1043; SEQ ID NO: 1045; SEQ ID NO: 1047; and SEQ ID NO: 1049, which correspond to the FRs (constant regions) of the heavy chain sequence of SEQ ID NO: 1041, or the heavy chain variable region sequence of SEQ ID NO: 1042, and/or one, two, three, or four of the polypeptide sequences of SEQ ID NO: 1063; SEQ ID NO: 1065; SEQ ID NO: 1067; and SEQ ID NO: 1069, which correspond to the FRs (constant regions) of the light chain sequence of SEQ ID NO: 1061, or the light chain variable region sequence of SEQ ID NO: 1062, or combinations of these polypeptide sequences, or sequences that are at least 80%, 90%, 95%, 96%, 97%, 98%, or 99% identical therewith.

In another embodiment of the invention, the anti-PACAP antibodies and antigen-binding fragments of the invention or fragments comprise, or alternatively consist of, combinations of one or more of the FRs, CDRs, the heavy chain variable region and light chain variable region sequences, and the heavy chain and light chain sequences set forth above, including all of them, or sequences that are at least 90% or 95% identical thereto.

In another embodiment of the invention, the anti-PACAP antibodies and antigen-binding fragments of the invention comprise, or alternatively consist of, the polypeptide sequence of SEQ ID NO: 1041, or SEQ ID NO: 1042, or polypeptides that are at least 90% or 95% identical thereto. In another embodiment of the invention, the antibodies and antigen-binding fragments of the invention comprise, or alternatively consist of, the polypeptide sequence of SEQ ID NO: 1061, or SEQ ID NO: 1062, or polypeptides that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 1044; SEQ ID NO: 1046; and SEQ ID NO: 1048, which correspond to the CDRs (hypervariable regions) of the heavy chain sequence of SEQ ID NO: 1041, or the heavy chain variable region sequence of SEQ ID NO: 1042, or sequences that are at least 90% or 95% identical thereto.

In a further embodiment of the invention, the antibodies and antigen-binding fragments having binding specificity to PACAP comprise, or alternatively consist of, one, two, or three of the polypeptide sequences of SEQ ID NO: 1064; SEQ ID NO: 1066; and SEQ ID NO: 1068, which correspond to the CDRs (hypervariable regions) of the light chain sequence of SEQ ID NO: 1061, or the light chain variable region sequence of SEQ ID NO: 1062, or sequences that are at least 90% or 95% identical thereto.

In a further embodiment of the invention, the antibodies and antigen-binding fragments having binding specificity to PACAP comprise, or alternatively consist of, one, two, three, or four of the polypeptide sequences of SEQ ID NO: 1043; SEQ ID NO: 1045; SEQ ID NO: 1047; and SEQ ID NO: 1049, which correspond to the FRs (constant regions) of the heavy chain sequence of SEQ ID NO: 1041, or the heavy chain variable region sequence of SEQ ID NO: 1042, or sequences that are at least 90% or 95% identical thereto.

In a further embodiment of the invention, the subject antibodies and antigen-binding fragments having binding specificity to PACAP comprise, or alternatively consist of, one, two, three, or four of the polypeptide sequences of SEQ ID NO: 1063; SEQ ID NO: 1065; SEQ ID NO: 1067; and SEQ ID NO: 1069, which correspond to the FRs (constant regions) of the light chain sequence of SEQ ID NO: 1061, or the light chain variable region sequence of SEQ ID NO: 1062, or sequences that are at least 90% or 95% identical thereto.

The invention also contemplates anti-PACAP antibodies and antigen-binding fragments that include one or more of the antibody fragments described herein. In one embodiment of the invention, antibodies and antigen-binding fragments having binding specificity to PACAP comprise, or alternatively consist of, one, two, three, or more, including all of the following antibody fragments: the heavy chain variable region of SEQ ID NO: 1042; the light chain variable region of SEQ ID NO: 1062; the complementarity determining regions (SEQ ID NO: 1044; SEQ ID NO: 1046; and SEQ ID NO: 1048) of the heavy chain variable region of SEQ ID NO: 1042; and the complementarity determining regions (SEQ ID NO: 1064; SEQ ID NO: 1066; and SEQ ID NO: 1068) of the light chain variable region of SEQ ID NO: 1062, or sequences that are at least 90% or 95% identical thereto. In another embodiment of the invention, fragments of the antibodies having binding specificity to PACAP comprise, or alternatively consist of, one, two, three, or more, including all of the following antibody fragments: the heavy chain variable region of SEQ ID NO: 1042; the light chain region of SEQ ID NO: 1062; the framework regions (SEQ ID NO: 1043; SEQ ID NO: 1045; SEQ ID NO: 1047; and SEQ ID NO: 1049) of the variable heavy chain region of SEQ ID NO: 1042; and the framework regions (SEQ ID NO: 1063; SEQ ID NO: 1065; SEQ ID NO: 1067; and SEQ ID NO: 1069) of the light chain variable region of SEQ ID NO: 1062, or sequences that are at least 90% or 95% identical thereto.

In another embodiment of the invention, the anti-PACAP antibody is Ab12.H, comprising, or alternatively consisting of, SEQ ID NO: 1041 and SEQ ID NO: 1061, or SEQ ID NO: 1042 and SEQ ID NO: 1062, or an antibody or antigen-binding fragment comprising the CDRs of Ab12.H and having at least one of the biological activities set forth herein, or is an anti-PACAP antibody that competes with Ab12.H in binding PACAP, preferably one containing sequences that are at least 90%, 95%, 96%, 97%, 98%, or 99% identical to that of Ab12.H, or an antibody that binds to the same or overlapping epitope(s) on PACAP as Ab12.H.

In a further embodiment of the invention, antigen-binding fragments comprise, or alternatively consist of, Fab fragments having binding specificity for PACAP. With respect to antibody Ab12.H, the Fab fragment preferably includes the heavy chain variable region sequence of SEQ ID NO: 1042 and the light chain variable region sequence of SEQ ID NO: 1062, or sequences that are at least 90%, 95%, 96%, 97%, 98%, or 99% identical thereto. This embodiment of the invention further includes Fabs containing additions, deletions, and variants of SEQ ID NO: 1042 and/or SEQ ID NO: 1062 that retain the binding specificity for PACAP.

In one embodiment of the invention described herein, Fab fragments may be produced by enzymatic digestion (e.g., papain) of Ab12.H. In another embodiment of the invention, anti-PACAP antibodies such as Ab12.H and Fab fragments may be produced via expression in mammalian cells, such as CHO, NSO, or HEK 293 cells, fungal, insect, or microbial systems, such as yeast cells (for example haploid or diploid yeast, such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PACAP, including the heavy and/or light chains of Ab12.H, as well as fragments, variants, and combinations of one or more of the FRs, CDRs, the heavy chain variable region and light chain variable region sequences, and the heavy chain and light chain sequences set forth above, including all of them, or sequences that are at least 90% or 95% identical thereto.

In another embodiment, the invention contemplates an isolated anti-PACAP antibody comprising a $V_H$ polypeptide sequence selected from: SEQ ID NO: 802; SEQ ID NO: 1122; SEQ ID NO: 1082; SEQ ID NO: 1002; SEQ ID NO: 1162; SEQ ID NO: 1042, or a variant thereof; and further comprising a $V_L$ polypeptide sequence selected from: SEQ ID NO: 822; SEQ ID NO: 1142; SEQ ID NO: 1102; SEQ ID NO: 1022; SEQ ID NO: 1182; SEQ ID NO: 1062, or a variant thereof, wherein optionally one or more of the framework region residues ("FR residues") and/or CDR residues in said $V_H$ or $V_L$ polypeptide has been substituted with another amino acid residue resulting in an anti-PACAP antibody that specifically binds PACAP. The invention contemplates an isolated anti-PACAP antibody comprising a $V_H$ polypeptide sequence and a $V_L$ polypeptide sequence selected from: SEQ ID NO: 802 and SEQ ID NO: 822; SEQ ID NO: 1122 and SEQ ID NO: 1142; SEQ ID NO: 1082 and SEQ ID NO: 1102; SEQ ID NO: 1002 and SEQ ID NO: 1022; SEQ ID NO: 1162 and SEQ ID NO: 1182; or SEQ ID NO: 1042 and SEQ ID NO: 1062, or a variant thereof, wherein one or more of the framework region residues ("FR residues") and/or CDR residues in said $V_H$ or $V_L$ polypeptide has been substituted with another amino acid residue resulting in an anti-PACAP antibody that specifically binds PACAP. The invention also includes humanized and chimeric forms of these antibodies. The chimeric and humanized antibodies may include an Fc derived from IgG1, IgG2, IgG3, or IgG4 constant regions.

In one embodiment of the invention, the chimeric or humanized antibodies or fragments or $V_H$ or $V_L$ polypeptides originate or are derived from one or more rabbit antibodies, e.g., a rabbit antibody isolated from a clonal rabbit B cell population.

In some aspects, the invention provides a vector comprising a nucleic acid molecule encoding an anti-PACAP antibody or fragment thereof as disclosed herein. In some embodiments, the invention provides a host cell comprising a nucleic acid molecule encoding an anti-PACAP antibody or fragment thereof as disclosed herein.

In some aspects, the invention provides an isolated antibody or antigen binding fragment thereof that competes for binding to PACAP with an antibody or antigen binding fragment thereof disclosed herein.

In some aspects, the invention provides a nucleic acid molecule encoding an antibody or antigen binding fragment thereof as disclosed herein.

In some aspects, the invention provides a pharmaceutical or diagnostic composition comprising at least one antibody or antigen binding fragment thereof as disclosed herein.

In some aspects, the invention provides a method for treating or preventing a condition associated with elevated PACAP levels in a subject, comprising administering to a subject in need thereof an effective amount of at least one isolated antibody or antigen binding fragment thereof as disclosed herein.

In some aspects, the invention provides a method of inhibiting binding of PACAP to PAC1-R, VPAC1-R, and/or VPAC2-R in a subject comprising administering an effective amount of at least one antibody or antigen binding fragment thereof as disclosed herein.

In some aspects, the invention provides an antibody or antigen binding fragment thereof that selectively binds to PACAP, wherein the antibody or antigen binding fragment thereof binds to PACAP with a $K_D$ of less than or equal to $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, $10^{-10}$ M, $5\times10^{-11}$ M, $10^{-11}$ M, $5\times10^{-12}$ M; $10^{-12}$ M, $5\times10^{-13}$ M, or $10^{-13}$ M; preferably, with a $K_D$ of less than or equal to $5\times10^{-10}$ M, $10^{-10}$ M, $5\times10^{-11}$ M, $10^{-11}$ M, $5\times10^{-12}$ M, or $10^{-12}$ M; more preferably, with a $K_D$ that is less than about 100 pM, less than about 50 pM, less than about 40 pM, less than about 25 pM, less than about 1 pM, between about 10 pM and about 100 pM, between about 1 pM and about 100 pM, or between about 1 pM and about 10 pM. Preferably, the anti-PACAP antibody or antigen binding fragment thereof has no cross-reactivity or minimal cross-reactivity with VIP.

The inventive antibodies and antigen binding fragments thereof may be modified post-translationally to add effector moieties such as chemical linkers, detectable moieties such as for example fluorescent dyes, enzymes, substrates, bioluminescent materials, radioactive materials, and chemiluminescent moieties, or functional moieties such as for example streptavidin, avidin, biotin, a cytotoxin, a cytotoxic agent, and radioactive materials.

Antibodies and antigen binding fragments thereof may also be chemically modified to provide additional advantages such as increased solubility, stability and circulating time (in vivo half-life) of the polypeptide, or decreased immunogenicity (See U.S. Pat. No. 4,179,337). The chemical moieties for derivatization may be selected from water soluble polymers such as polyethylene glycol, ethylene glycol/propylene glycol copolymers, carboxymethylcellulose, dextran, polyvinyl alcohol, and the like. The antibodies and fragments thereof may be modified at random positions within the molecule, or at predetermined positions within the molecule and may include one, two, three, or more attached chemical moieties.

The polymer may be of any molecular weight, and may be branched or unbranched. For polyethylene glycol, the preferred molecular weight is between about 1 kDa and about 100 kDa (the term "about" indicating that in preparations of polyethylene glycol, some molecules will weigh more, some less, than the stated molecular weight) for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a therapeutic protein or analog). For example, the polyethylene glycol may have an average molecular weight of about 200, 500, 1000, 1500, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 25,000, 30,000, 35,000, 40,000, 50,000, 55,000, 60,000, 65,000, 70,000, 75,000, 80,000, 85,000, 90,000, 95,000, or 100,000 kDa. Branched polyethylene glycols are described, for example, in U.S. Pat. No. 5,643,575; Morpurgo et al., *Appl. Biochem. Biotechnol.,* 56:59-72 (1996); Vorobjev et al., *Nucleosides and Nucleotides,* 18:2745-2750 (1999); and Caliceti et al., *Bioconjug. Chem.,* 10:638-646 (1999), the disclosures of each of which are incorporated herein by reference.

There are a number of attachment methods available to those skilled in the art (See e.g., EP 0 401 384, herein incorporated by reference, disclosing a method of coupling PEG to G-CSF; and Malik et al., *Exp. Hematol.,* 20:1028-1035 (1992) (reporting pegylation of GM-CSF using tresyl chloride)). For example, polyethylene glycol may be covalently bound through amino acid residues via a reactive group, such as, a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues glutamic acid residues and the C-terminal amino acid residue. Sulfhydryl groups may also be used as a reactive group for attaching the polyethylene glycol molecules. Preferred for therapeutic purposes is attachment at an amino group, such as attachment at the N-terminus or lysine group.

As suggested above, polyethylene glycol may be attached to proteins via linkage to any of a number of amino acid residues. For example, polyethylene glycol can be linked to polypeptides via covalent bonds to lysine, histidine, aspartic acid, glutamic acid, or cysteine residues. One or more reaction chemistries may be employed to attach polyethylene glycol to specific amino acid residues (e.g., lysine, histidine, aspartic acid, glutamic acid, or cysteine) or to more than one type of amino acid residue (e.g., lysine, histidine, aspartic acid, glutamic acid, cysteine and combinations thereof).

Alternatively, antibodies or antigen binding fragments thereof may have increased in vivo half-lives via fusion with albumin (including but not limited to recombinant human serum albumin or fragments or variants thereof (See, e.g., U.S. Pat. No. 5,876,969, EP 0 413 622, and U.S. Pat. No. 5,766,883, herein incorporated by reference in their entirety)), or other circulating blood proteins such as transferrin or ferritin. In a preferred embodiment, polypeptides and/or antibodies of the present invention (including fragments or variants thereof) are fused with the mature form of human serum albumin (i.e., amino acids 1-585 of human serum albumin as shown in FIGS. 1 and 2 of EP 0 322 094) which is herein incorporated by reference in its entirety. Polynucleotides encoding fusion proteins of the invention are also encompassed by the invention.

Regarding detectable moieties, further exemplary enzymes include, but are not limited to, horseradish peroxidase, acetylcholinesterase, alkaline phosphatase, beta-galactosidase, and luciferase. Further exemplary fluorescent materials include, but are not limited to, rhodamine, fluorescein, fluorescein isothiocyanate, umbelliferone, dichlorotriazinylamine, phycoerythrin, and dansyl chloride. Further exemplary chemiluminescent moieties include, but are not limited to, luminol. Further exemplary bioluminescent materials include, but are not limited to, luciferin and aequorin. Further exemplary radioactive materials include, but are not limited to, Iodine 125 ($^{125}$I) Carbon 14 ($^{14}$C), Sulfur 35 ($^{35}$S), Tritium ($^3$H) and Phosphorus 32 ($^{32}$P).

Methods are known in the art for conjugating an antibody or antigen binding fragment thereof to a detectable moiety and the like, such as for example those methods described by Hunter et al., *Nature*, 144:945 (1962); David et al., *Biochemistry*, 13:1014 (1974); Pain et al., *J. Immunol. Meth.*, 40:219 (1981); and Nygren, J., *Histochem. and Cytochem.*, 30:407 (1982).

Embodiments described herein further include variants and equivalents that are substantially homologous to the antibodies, antibody fragments, diabodies, SMIPs, camelbodies, nanobodies, IgNAR, polypeptides, variable regions, and CDRs set forth herein. These may contain, e.g., conservative substitution mutations, (i.e., the substitution of one or more amino acids by similar amino acids). For example, conservative substitution refers to the substitution of an amino acid with another within the same general class, e.g., one acidic amino acid with another acidic amino acid, one basic amino acid with another basic amino acid, or one neutral amino acid by another neutral amino acid. What is intended by a conservative amino acid substitution is well known in the art.

In another embodiment, the invention contemplates polypeptide sequences having at least 90% or greater sequence homology to any one or more of the polypeptide sequences of antigen binding fragments, variable regions and CDRs set forth herein. More preferably, the invention contemplates polypeptide sequences having at least 95% or greater sequence homology, even more preferably at least 98% or greater sequence homology, and still more preferably at least 99% or greater sequence homology to any one or more of the polypeptide sequences of antigen binding fragments, variable regions, and CDRs set forth herein.

Methods for determining homology between nucleic acid and amino acid sequences are well known to those of ordinary skill in the art.

In another embodiment, the invention further contemplates the above-recited polypeptide homologs of the antigen binding fragments, variable regions and CDRs set forth herein further having anti-PACAP activity. Non-limiting examples of anti-PACAP activity are set forth herein, e.g., ability to inhibit PACAP binding to PAC1-R, VPAC1-R, and/or VPAC2-R, thereby resulting in the reduced production of cAMP.

In another embodiment, the invention further contemplates the generation and use of antibodies that bind any of the foregoing sequences, including, but not limited to, anti-idiotypic antibodies. In an exemplary embodiment, such an anti-idiotypic antibody could be administered to a subject who has received an anti-PACAP antibody to modulate, reduce, or neutralize, the effect of the anti-PACAP antibody. Such antibodies could also be useful for treatment of an autoimmune disease characterized by the presence of anti-PACAP antibodies. A further exemplary use of such antibodies, e.g., anti-idiotypic antibodies, is for detection of the anti-PACAP antibodies of the present invention, for example to monitor the levels of the anti-PACAP antibodies present in a subject's blood or other bodily fluids. For example, in one embodiment, the invention provides a method of using the anti-idiotypic antibody to monitor the in vivo levels of said anti-PACAP antibody or antigen binding fragment thereof in a subject or to neutralize said anti-PACAP antibody in a subject being administered said anti-PACAP antibody or antigen binding fragment thereof.

The present invention also contemplates anti-PACAP antibodies comprising any of the polypeptide or polynucleotide sequences described herein substituted for any of the other polynucleotide sequences described herein. For example, without limitation thereto, the present invention contemplates antibodies comprising the combination of any of the light chain variable region and heavy chain variable region sequences described herein, and further contemplates antibodies resulting from substitution of any of the CDR sequences described herein for any of the other CDR sequences described herein.

Exemplary Polynucleotides Encoding Anti-PACAP Antibody Polypeptides

The invention is further directed to polynucleotides encoding antibody polypeptides having binding specificity to PACAP.

Antibody Ab3.H

In one embodiment, the invention is further directed to polynucleotides encoding antibody polypeptides having binding specificity to PACAP. In one embodiment of the invention, polynucleotides of the invention comprise, or alternatively consist of, the polynucleotide sequence of SEQ ID NO: 1131 which encodes the heavy chain sequence of SEQ ID NO: 1121 and which consists of the heavy chain variable region coding sequence of SEQ ID NO: 1132 and the heavy chain constant region coding sequence of SEQ ID NO: 1140.

In another embodiment of the invention, the polynucleotides of the invention comprise, or alternatively consist of, the following polynucleotide sequence encoding the heavy chain variable region polypeptide sequence of SEQ ID NO: 1122:

(SEQ ID NO: 1132)
gaggtgcagcttgtggagtctgggggaggcttggtccagcctggggggtc cctgagactctcctgtgcagcctctggattctccttcagtagcagcgact acatgtgctgggtccgtcaggctccagggaaggggctggagtggatcgga tgcattgatgctggtagtagtggtgacacttacttcgcgagctctgcgaa aggccgattcaccatctccagagacaattccaagaacaccgtgtatcttc

```
aaatgaacagcctgagagctgaggacactgctgtgtatttctgtgctaga catctttatggtagtattactttcgcctttggcttgtggggccaagggac cctcgtcaccgtctcgagc.
```

In another embodiment of the invention, polynucleotides of the invention comprise, or alternatively consist of, the following polynucleotide sequence encoding the heavy chain constant region polypeptide sequence of SEQ ID NO: 1130:

```
                                    (SEQ ID NO: 1140)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagaaagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggt.
```

In another embodiment of the invention, polynucleotides comprise, or alternatively consist of, the polynucleotide sequence of SEQ ID NO: 1151 which encodes the light chain polypeptide sequence of SEQ ID NO: 1141 and which consists of the light chain variable region coding sequence of SEQ ID NO: 1152 and the light chain constant region coding sequence of SEQ ID NO: 1160.

In another embodiment of the invention, polynucleotides of the invention comprise, or alternatively consist of, the following polynucleotide sequence encoding the light chain variable region polypeptide sequence of SEQ ID NO: 1142:

```
                                    (SEQ ID NO: 1152)
gcagcccagatgacccagtctccttccaccctgtctgcatctgtaggaga cagagtcaccatcacttgtcaggccagtcagagcattggtagcgacttag cctggtatcagcagaaaccaggaaaagcccctaagctcctgatctatgat gcatccactctggcatctggagtcccatcaaggttcagcggcagtggatc
```

```
tggaacagaattcactctcaccatcagcagcctgcagcctgatgattttg caacttactactgtcaaggcacttattatagtagtggttggtacactgct ttcggcggaggaaccaaggtggaaatcaaacgt.
```

In another embodiment of the invention, polynucleotides of the invention comprise, or alternatively consist of, the following polynucleotide sequence encoding the light chain constant region polypeptide sequence of SEQ ID NO: 1150:

```
                                    (SEQ ID NO: 1160)
acggtagcggccccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.
```

In a further embodiment of the invention, polynucleotides encoding antigen-binding fragments having binding specificity to PACAP comprise, or alternatively consist of, one or more of the polynucleotide sequences of SEQ ID NO: 1134; SEQ ID NO: 1136; and SEQ ID NO: 1138, which correspond to polynucleotides encoding the CDRs (hypervariable regions) of the heavy chain sequence of SEQ ID NO: 1121, or the heavy chain variable region sequence of SEQ ID NO: 1122, and/or one or more of the polynucleotide sequences of SEQ ID NO: 1154; SEQ ID NO: 1156; and SEQ ID NO: 1158, which correspond to the CDRs (hypervariable regions) of the light chain sequence of SEQ ID NO: 1141, or the light chain variable region sequence of SEQ ID NO: 1142, or combinations of these polynucleotide sequences. In another embodiment of the invention, the polynucleotides encoding the antibodies of the invention or antigen-binding fragments thereof comprise, or alternatively consist of, combinations of polynucleotides encoding one or more of the CDRs, the heavy chain variable region and light chain variable region sequences, and the heavy chain and light chain sequences set forth above, including all of them.

In a further embodiment of the invention, polynucleotides encoding antigen-binding fragments having binding specificity to PACAP comprise, or alternatively consist of, one or more of the polynucleotide sequences of SEQ ID NO: 1133; SEQ ID NO: 1135; SEQ ID NO: 1137; and SEQ ID NO: 1139, which correspond to polynucleotides encoding the FRs (constant regions) of the heavy chain sequence of SEQ ID NO: 1121, or the heavy chain variable region sequence of SEQ ID NO: 1122, and/or one or more of the polynucleotide sequences of SEQ ID NO: 1153; SEQ ID NO: 1155; SEQ ID NO: 1157; and SEQ ID NO: 1159, which correspond to the FRs (constant regions) of the light chain sequence of SEQ ID NO: 1141, or the light chain variable region sequence of SEQ ID NO: 1142, or combinations of these polynucleotide sequences. In another embodiment of the invention, the polynucleotides encoding the antibodies of the invention or fragments thereof comprise, or alternatively consist of, combinations of one or more of the FRs, the heavy chain variable region and light chain variable region sequences, and the heavy chain and light chain sequences set forth above, including all of them.

The invention also contemplates polynucleotide sequences including one or more of the polynucleotide sequences encoding antigen-binding fragments described herein. In one embodiment of the invention, polynucleotides encoding antigen-binding fragments having binding specificity to PACAP comprise, or alternatively consist of, one, two, three or more, including all of the following polynucleotides encoding antigen-binding fragments: the polynucleotide SEQ ID NO: 1131 encoding the heavy chain sequence of SEQ ID NO: 1121; the polynucleotide SEQ ID NO: 1132 encoding the heavy chain variable region sequence of SEQ ID NO: 1122; the polynucleotide SEQ ID NO: 1151 encoding the light chain sequence of SEQ ID NO: 1141; the polynucleotide SEQ ID NO: 1152 encoding the light chain variable region sequence of SEQ ID NO: 1142; polynucleotides encoding the CDRs (SEQ ID NO: 1134; SEQ ID NO: 1136; and SEQ ID NO: 1138) of the heavy chain sequence of SEQ ID NO: 1121, or the heavy chain variable region sequence of SEQ ID NO: 1122; polynucleotides encoding the CDRs (SEQ ID NO: 1154; SEQ ID NO: 1156; and SEQ ID NO: 1158) of the light chain sequence of SEQ ID NO: 1141, or the variable light chain sequence of SEQ ID NO: 1142; polynucleotides encoding the FRs (SEQ ID NO: 1133; SEQ ID NO: 1135; SEQ ID NO: 1137; and SEQ ID NO: 1139) of the heavy chain sequence of SEQ ID NO: 1121, or the heavy chain variable region sequence of SEQ ID NO: 1122; and polynucleotides encoding the FRs (SEQ ID NO: 1153; SEQ ID NO: 1155; SEQ ID NO: 1157; and SEQ ID NO: 1159) of the light chain sequence of SEQ ID NO: 1141, or the light chain variable region sequence of SEQ ID NO: 1142.

In another embodiment of the invention, polynucleotides of the invention comprise, or alternatively consist of, polynucleotides encoding Fab fragments having binding specificity for PACAP. With respect to antibody Ab3.H, the polynucleotides encoding the full length Ab3.H antibody comprise, or alternatively consist of, the polynucleotide SEQ ID NO: 1131 encoding the heavy chain sequence of SEQ ID NO: 1121, and the polynucleotide SEQ ID NO: 1151 encoding the light chain sequence of SEQ ID NO: 1141.

Another embodiment of the invention contemplates these polynucleotides incorporated into an expression vector for expression in mammalian cells such as CHO, NSO, or HEK-293 cells, or in fungal, insect, or microbial systems such as yeast cells such as the yeast *Pichia*. Suitable *Pichia* species include, but are not limited to, *Pichia pastoris*. In one embodiment of the invention described herein, Fab fragments can be produced by enzymatic digestion (e.g., papain) of Ab3.H following expression of the full-length polynucleotides in a suitable host. In another embodiment of the invention, anti-PACAP antibodies, such as Ab3.H or Fab fragments thereof, can be produced via expression of Ab3.H polynucleotides in mammalian cells such as CHO, NSO, or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab4.H

In one embodiment, the invention is further directed to polynucleotides encoding antibody polypeptides having binding specificity to PACAP. In one embodiment of the invention, polynucleotides of the invention comprise, or alternatively consist of, the polynucleotide sequence of SEQ ID NO: 1091 which encodes the heavy chain sequence of SEQ ID NO: 1081 and which consists of the heavy chain variable region coding sequence of SEQ ID NO: 1092 and the heavy chain constant region coding sequence of SEQ ID NO: 1100.

In another embodiment of the invention, the polynucleotides of the invention comprise, or alternatively consist of, the following polynucleotide sequence encoding the heavy chain variable region polypeptide sequence of SEQ ID NO: 1082:

```
(SEQ ID NO: 1092)
gaggtgcagcttgtggagtctgggggaggcttggtccagcctggggggtcc ctgagactctcctgtgcagcctctggattctccctcagtagctacgacatg agctgggtccgtcaggctccagggaaggggctggagtggatcggaatcatt aatactaatgatgacacatggtacgcgagctgggtgaaaggccgattcacc atctccagagacaattccaagaacaccctgtatcttcaaatgaacagcctg agagctgaggacactgctgtgtattactgtgctagaatatccgatgcttat gtttttgattatgcgtattactttactttgtggggccaagggaccctcgtc accgtctcgagc.
```

In another embodiment of the invention, polynucleotides of the invention comprise, or alternatively consist of, the following polynucleotide sequence encoding the heavy chain constant region polypeptide sequence of SEQ ID NO: 1090:

```
(SEQ ID NO: 1100)
gcctccaccaagggcccatcggtcttccccctggcaccctcctccaagagc acctctgggggcacagcggccctgggctgcctggtcaaggactacttcccc gaaccggtgacggtgtcgtggaactcaggcgccctgaccagcggcgtgcac accttcccggctgtcctacagtcctcaggactctactccctcagcagcgtg gtgaccgtgccctccagcagcttgggcacccagacctacatctgcaacgtg aatcacaagcccagcaacaccaaggtggacaagaaagttgagcccaaatct tgtgacaaaactcacacatgcccaccgtgcccagcacctgaactcctgggg ggaccgtcagtcttcctcttccccccaaaacccaaggacaccctcatgatc tcccggacccctgaggtcacatgcgtggtggtggacgtgagccacgaagac cctgaggtcaagttcaactggtacgtggacggcgtggaggtgcataatgcc aagacaaagccgcgggaggagcagtacgccagcacgtaccgtgtggtcagc gtcctcaccgtcctgcaccaggactggctgaatggcaaggagtacaagtgc aaggtctccaacaaagccctcccagcccccatcgagaaaaccatctccaaa gccaaagggcagccccgagaaccacaggtgtacaccctgcccccatcccgg gaggagatgaccaagaaccaggtcagcctgacctgcctggtcaaaggcttc tatcccagcgacatcgccgtggagtgggagagcaatgggcagccggagaac aactacaagaccacgcctcccgtgctggactccgacggctccttcttcctc tacagcaagctcaccgtggacaagagcaggtggcagcaggggaacgtcttc tcatgctccgtgatgcatgaggctctgcacaaccactacacgcagaagagc ctctccctgtctccgggtaaa.
```

In another embodiment of the invention, polynucleotides comprise, or alternatively consist of, the polynucleotide sequence of SEQ ID NO: 1111 which encodes the light chain polypeptide sequence of SEQ ID NO: 1101 and which consists of the light chain variable region coding sequence of SEQ ID NO: 1112 and the light chain constant region coding sequence of SEQ ID NO: 1120.

In another embodiment of the invention, polynucleotides of the invention comprise, or alternatively consist of, the following polynucleotide sequence encoding the light chain variable region polypeptide sequence of SEQ ID NO: 1102:

```
                                          (SEQ ID NO: 1112)
gacatccagatgacccagtctccttccacctgtctgcatctgtaggagac agagtcaccatcacttgtctggccagtcagaacatttacaattcttt agcc tggtatcagcagaaaccaggaaaagcccctaagctcctgatctatgggca tccactctggcatctggagtcccatcaaggttcagcggcagtggatctgga acagaattcactctcaccatcagcagcctgcagcctgatgattttgcaact tactactgtcaacagggtgctggtgctgataatattggtaatcctttcggc ggaggaaccaaggtggaaatcaaacgt.
```

In another embodiment of the invention, polynucleotides of the invention comprise, or alternatively consist of, the following polynucleotide sequence encoding the light chain constant region polypeptide sequence of SEQ ID NO: 1110:

```
                                          (SEQ ID NO: 1120)
acggtagcggccccatctgtcttcatcttcccgccatctgatgagcagttg aaatctggaactgcctctgttgtgtgcctgctgaataacttctatcccaga gaggccaaagtacagtggaaggtggataacgccctccaatcgggtaactcc caggagagtgtcacagagcaggacagcaaggacagcacctacagcctcagc agcaccctgacgctgagcaaagcagactacgagaaacacaaagtctacgcc tgcgaagtcacccatcagggcctgagctcgcccgtcacaaagagcttcaac aggggagagtgt.
```

In a further embodiment of the invention, polynucleotides encoding antigen-binding fragments having binding specificity to PACAP comprise, or alternatively consist of, one or more of the polynucleotide sequences of SEQ ID NO: 1094; SEQ ID NO: 1096; and SEQ ID NO: 1098, which correspond to polynucleotides encoding the CDRs (hypervariable regions) of the heavy chain sequence of SEQ ID NO: 1081, or the heavy chain variable region sequence of SEQ ID NO: 1082, and/or one or more of the polynucleotide sequences of SEQ ID NO: 1114; SEQ ID NO: 1116; and SEQ ID NO: 1118, which correspond to the CDRs (hypervariable regions) of the light chain sequence of SEQ ID NO: 1101, or the light chain variable region sequence of SEQ ID NO: 1102, or combinations of these polynucleotide sequences. In another embodiment of the invention, the polynucleotides encoding the antibodies of the invention or antigen-binding fragments thereof comprise, or alternatively consist of, combinations of polynucleotides encoding one or more of the CDRs, the heavy chain variable region and light chain variable region sequences, and the heavy chain and light chain sequences set forth above, including all of them.

In a further embodiment of the invention, polynucleotides encoding antigen-binding fragments having binding specificity to PACAP comprise, or alternatively consist of, one or more of the polynucleotide sequences of SEQ ID NO: 1093; SEQ ID NO: 1095; SEQ ID NO: 1097; and SEQ ID NO: 1099, which correspond to polynucleotides encoding the FRs (constant regions) of the heavy chain sequence of SEQ ID NO: 1081, or the heavy chain variable region sequence of SEQ ID NO: 1082, and/or one or more of the polynucleotide sequences of SEQ ID NO: 1113; SEQ ID NO: 1115; SEQ ID NO: 1117; and SEQ ID NO: 1119, which correspond to the FRs (constant regions) of the light chain sequence of SEQ ID NO: 1101, or the light chain variable region sequence of SEQ ID NO: 1102, or combinations of these polynucleotide sequences. In another embodiment of the invention, the polynucleotides encoding the antibodies of the invention or fragments thereof comprise, or alternatively consist of, combinations of one or more of the FRs, the heavy chain variable region and light chain variable region sequences, and the heavy chain and light chain sequences set forth above, including all of them.

The invention also contemplates polynucleotide sequences including one or more of the polynucleotide sequences encoding antigen-binding fragments described herein. In one embodiment of the invention, polynucleotides encoding antigen-binding fragments having binding specificity to PACAP comprise, or alternatively consist of, one, two, three or more, including all of the following polynucleotides encoding antigen-binding fragments: the polynucleotide SEQ ID NO: 1091 encoding the heavy chain sequence of SEQ ID NO: 1081; the polynucleotide SEQ ID NO: 1092 encoding the heavy chain variable region sequence of SEQ ID NO: 1082; the polynucleotide SEQ ID NO: 1111 encoding the light chain sequence of SEQ ID NO: 1101; the polynucleotide SEQ ID NO: 1112 encoding the light chain variable region sequence of SEQ ID NO: 1102; polynucleotides encoding the CDRs (SEQ ID NO: 1094; SEQ ID NO: 1096; and SEQ ID NO: 1098) of the heavy chain sequence of SEQ ID NO: 1081, or the heavy chain variable region sequence of SEQ ID NO: 1082; polynucleotides encoding the CDRs (SEQ ID NO: 1114; SEQ ID NO: 1116; and SEQ ID NO: 1118) of the light chain sequence of SEQ ID NO: 1101, or the light chain variable region sequence of SEQ ID NO: 1102; polynucleotides encoding the FRs (SEQ ID NO: 1093; SEQ ID NO: 1095; SEQ ID NO: 1097; and SEQ ID NO: 1099) of the heavy chain sequence of SEQ ID NO: 1081, or the heavy chain variable region sequence of SEQ ID NO: 1082; and polynucleotides encoding the FRs (SEQ ID NO: 1113; SEQ ID NO: 1115; SEQ ID NO: 1117; and SEQ ID NO: 1119) of the light chain sequence of SEQ ID NO: 1101, or the light chain variable region sequence of SEQ ID NO: 1102.

In another embodiment of the invention, polynucleotides of the invention comprise, or alternatively consist of, polynucleotides encoding Fab fragments having binding specificity for PACAP. With respect to antibody Ab4.H, the polynucleotides encoding the full length Ab4.H antibody comprise, or alternatively consist of, the polynucleotide SEQ ID NO: 1091 encoding the heavy chain sequence of SEQ ID NO: 1081, and the polynucleotide SEQ ID NO: 1111 encoding the light chain sequence of SEQ ID NO: 1101.

Another embodiment of the invention contemplates these polynucleotides incorporated into an expression vector for expression in mammalian cells such as CHO, NSO, or HEK-293 cells, or in fungal, insect, or microbial systems such as yeast cells such as the yeast *Pichia*. Suitable *Pichia* species include, but are not limited to, *Pichia pastoris*. In one embodiment of the invention described herein, Fab fragments can be produced by enzymatic digestion (e.g., papain) of Ab4.H following expression of the full-length polynucleotides in a suitable host. In another embodiment of the invention, anti-PACAP antibodies, such as Ab4.H or Fab fragments thereof, can be produced via expression of Ab4.H polynucleotides in mammalian cells such as CHO, NSO, or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab5.H

In one embodiment, the invention is further directed to polynucleotides encoding antibody polypeptides having binding specificity to PACAP. In one embodiment of the invention, polynucleotides of the invention comprise, or alternatively consist of, the polynucleotide sequence of SEQ ID NO: 1011 which encodes the heavy chain sequence of SEQ ID NO: 1001 and which consists of the heavy chain variable region coding sequence of SEQ ID NO: 1012 and the heavy chain constant region coding sequence of SEQ ID NO: 1020.

In another embodiment of the invention, the polynucleotides of the invention comprise, or alternatively consist of, the following polynucleotide sequence encoding the heavy chain variable region polypeptide sequence of SEQ ID NO: 1002:

```
                                                        (SEQ
gaggtgcagcttgtggagtctgggggaggcttggtccagcctggggggtcc ctgagactctcctgtgcagcctctggattctccctcagtagctatgcgatg atctgggtccgtcaggctccagggaaggggctggagtgggtcggaatcatt tatgataatggtgacacatactacgcgagctctgcgaaaggccgattcacc atctccagagacaattccaagaacaccgtgtatcttcaaatgaacagcctg agagctgaggacactgctgtgtatttctgtgctagagagcctggtagtact actcagaatgacttgtggggccaagggaccctcgtcaccgtctcgagc
```

In another embodiment of the invention, polynucleotides of the invention comprise, or alternatively consist of, the following polynucleotide sequence encoding the heavy chain constant region polypeptide sequence of SEQ ID NO: 1010:

```
                                            (SEQ ID NO: 1020)
gcctccaccaagggcccatcggtcttccccctggcaccctcctccaagagc acctctgggggcacagcggccctgggctgcctggtcaaggactacttcccc gaaccggtgacggtgtcgtggaactcaggcgccctgaccagcggcgtgcac accttcccggctgtcctacagtcctcaggactctactccctcagcagcgtg gtgaccgtgccctccagcagcttgggcacccagacctacatctgcaacgtg aatcacaagcccagcaacaccaaggtggacaagaaagttgagcccaaatct tgtgacaaaactcacacatgcccaccgtgcccagcacctgaactcctgggg ggaccgtcagtcttcctcttccccccaaaacccaaggacaccctcatgatc tcccggacccctgaggtcacatgcgtggtggtggacgtgagccacgaagac cctgaggtcaagttcaactggtacgtggacggcgtggaggtgcataatgcc aagacaaagccgcgggaggagcagtacgccagcacgtaccgtgtggtcagc gtcctcaccgtcctgcaccaggactggctgaatggcaaggagtacaagtgc aaggtctccaacaaagccctcccagcccccatcgagaaaaccatctccaaa gccaaagggcagccccgagaaccacaggtgtacaccctgcccccatcccgg gaggagatgaccaagaaccaggtcagcctgacctgcctggtcaaaggcttc
``` tatcccagcgacatcgccgtggagtgggagagcaatgggcagccggagaac aactacaagaccacgcctcccgtgctggactccgacggctccttcttcctc tacagcaagctcaccgtggacaagagcaggtggcagcaggggaacgtcttc tcatgctccgtgatgcatgaggctctgcacaaccactacacgcagaagagc ctctccctgtctccgggtaaa.
```

In another embodiment of the invention, polynucleotides comprise, or alternatively consist of, the polynucleotide sequence of SEQ ID NO: 1031 which encodes the light chain polypeptide sequence of SEQ ID NO: 1021 and which consists of the light chain variable region coding sequence of SEQ ID NO: 1032 and the light chain constant region coding sequence of SEQ ID NO: 1040.

In another embodiment of the invention, polynucleotides of the invention comprise, or alternatively consist of, the following polynucleotide sequence encoding the light chain variable region polypeptide sequence of SEQ ID NO: 1022:

```
                                            (SEQ ID NO: 1032)
gacgttcagatgacccagtctccttccaccctgtctgcatctgtaggagac agagtcaccatcacttgtcaggccagtgagaacatttacaactctttactc tggtatcagcagaaaccaggaaaagcccctaagctcctgatctatagggca tccactctggcatctggagtcccatcaaggttcagcggcagtggatctgga acagaattcactctcaccatcagcagcctgcagcctgatgattttgcaact tactactgtcaaaactattataatatatggactaatggtgctgctttcggc ggaggaaccaaggtggaaatcaaacgt.
```

In another embodiment of the invention, polynucleotides of the invention comprise, or alternatively consist of, the following polynucleotide sequence encoding the light chain constant region polypeptide sequence of SEQ ID NO: 1030:

```
                                            (SEQ ID NO: 1040)
acggtagcggcccccatctgtcttcatcttcccgccatctgatgagcagttg aaatctggaactgcctctgttgtgtgcctgctgaataacttctatcccaga gaggccaaagtacagtggaaggtggataacgccctccaatcgggtaactcc caggagagtgtcacagagcaggacagcaaggacagcacctacagcctcagc agcaccctgacgctgagcaaagcagactacgagaaacacaaagtctacgcc tgcgaagtcacccatcagggcctgagctcgcccgtcacaaagagcttcaac aggggagagtgt.
```

In a further embodiment of the invention, polynucleotides encoding antigen-binding fragments having binding specificity to PACAP comprise, or alternatively consist of, one or more of the polynucleotide sequences of SEQ ID NO: 1014; SEQ ID NO: 1016; and SEQ ID NO: 1018, which correspond to polynucleotides encoding the CDRs (hypervariable regions) of the heavy chain sequence of SEQ ID NO: 1001, or the heavy chain variable region sequence of SEQ ID NO: 1002, and/or one or more of the polynucleotide sequences of SEQ ID NO: 1034; SEQ ID NO: 1036; and SEQ ID NO: 1038, which correspond to the CDRs (hypervariable regions) of the light chain sequence of SEQ ID NO: 1021, or the light chain variable region sequence of SEQ ID NO: 1022, or combinations of these polynucleotide sequences. In another embodiment of the invention, the polynucleotides encoding the antibodies of the invention or antigen-binding fragments thereof comprise, or alternatively consist of, combinations of polynucleotides encoding one or more of the CDRs, the heavy chain variable region and light chain variable region sequences, and the heavy chain and light chain sequences set forth above, including all of them.

In a further embodiment of the invention, polynucleotides encoding antigen-binding fragments having binding specificity to PACAP comprise, or alternatively consist of, one or more of the polynucleotide sequences of SEQ ID NO: 1013; SEQ ID NO: 1015; SEQ ID NO: 1017; and SEQ ID NO: 1019, which correspond to polynucleotides encoding the FRs (constant regions) of the heavy chain sequence of SEQ ID NO: 1001, or the heavy chain variable region sequence of SEQ ID NO: 1002, and/or one or more of the polynucleotide sequences of SEQ ID NO: 1033; SEQ ID NO: 1035; SEQ ID NO: 1037; and SEQ ID NO: 1039, which correspond to the FRs (constant regions) of the light chain sequence of SEQ ID NO: 1021, or the light chain variable region sequence of SEQ ID NO: 1022, or combinations of these polynucleotide sequences. In another embodiment of the invention, the polynucleotides encoding the antibodies of the invention or fragments thereof comprise, or alternatively consist of, combinations of one or more of the FRs, the heavy chain variable region and light chain variable region sequences, and the heavy chain and light chain sequences set forth above, including all of them.

The invention also contemplates polynucleotide sequences including one or more of the polynucleotide sequences encoding antigen-binding fragments described herein. In one embodiment of the invention, polynucleotides encoding antigen-binding fragments having binding specificity to PACAP comprise, or alternatively consist of, one, two, three or more, including all of the following polynucleotides encoding antigen-binding fragments: the polynucleotide SEQ ID NO: 1011 encoding the heavy chain sequence of SEQ ID NO: 1001; the polynucleotide SEQ ID NO: 1012 encoding the heavy chain variable region sequence of SEQ ID NO: 1002; the polynucleotide SEQ ID NO: 1031 encoding the light chain sequence of SEQ ID NO: 1021; the polynucleotide SEQ ID NO: 1032 encoding the light chain variable region sequence of SEQ ID NO: 1022; polynucleotides encoding the CDRs (SEQ ID NO: 1014; SEQ ID NO: 1016; and SEQ ID NO: 1018) of the heavy chain sequence of SEQ ID NO: 1001, or the heavy chain variable region sequence of SEQ ID NO: 1002; polynucleotides encoding the CDRs (SEQ ID NO: 1034; SEQ ID NO: 1036; and SEQ ID NO: 1038) of the light chain sequence of SEQ ID NO: 1021, or the light chain variable region sequence of SEQ ID NO: 1022; polynucleotides encoding the FRs (SEQ ID NO: 1013; SEQ ID NO: 1015; SEQ ID NO: 1017; and SEQ ID NO: 1019) of the heavy chain sequence of SEQ ID NO: 1001, or the heavy chain variable region sequence of SEQ ID NO: 1002; and polynucleotides encoding the FRs (SEQ ID NO: 1033; SEQ ID NO: 1035; SEQ ID NO: 1037; and SEQ ID NO: 1039) of the light chain sequence of SEQ ID NO: 1021, or the light chain variable region sequence of SEQ ID NO: 1022.

In another embodiment of the invention, polynucleotides of the invention comprise, or alternatively consist of, polynucleotides encoding Fab fragments having binding specificity for PACAP. With respect to antibody Ab5.H, the polynucleotides encoding the full length Ab5.H antibody comprise, or alternatively consist of, the polynucleotide SEQ ID NO: 1011 encoding the heavy chain sequence of SEQ ID NO: 1001, and the polynucleotide SEQ ID NO: 1031 encoding the light chain sequence of SEQ ID NO: 1021.

Another embodiment of the invention contemplates these polynucleotides incorporated into an expression vector for expression in mammalian cells such as CHO, NSO, or HEK-293 cells, or in fungal, insect, or microbial systems such as yeast cells such as the yeast *Pichia*. Suitable *Pichia* species include, but are not limited to, *Pichia pastoris*. In one embodiment of the invention described herein, Fab fragments can be produced by enzymatic digestion (e.g., papain) of Ab5.H following expression of the full-length polynucleotides in a suitable host. In another embodiment of the invention, anti-PACAP antibodies, such as Ab5.H or Fab fragments thereof, can be produced via expression of Ab5.H polynucleotides in mammalian cells such as CHO, NSO, or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab9

In one embodiment, the invention is further directed to polynucleotides encoding antibody polypeptides having binding specificity to PACAP. In one embodiment of the invention, polynucleotides of the invention comprise, or alternatively consist of, the polynucleotide sequence of SEQ ID NO: 811 which encodes the heavy chain sequence of SEQ ID NO: 801 and which consists of the heavy chain variable region coding sequence of SEQ ID NO: 812 and the heavy chain constant region coding sequence of SEQ ID NO: 820.

In another embodiment of the invention, the polynucleotides of the invention comprise, or alternatively consist of, the following polynucleotide sequence encoding the heavy chain variable region polypeptide sequence of SEQ ID NO: 802:

(SEQ ID NO: 812)
cagcagctggagcagtccggaggaggagccgaaggaggcctggtcaagcct gggggatccctgaaactctcctgcaaagcctctggattcaccatcagtagg gactactggatatgttgggtccgccaggctccagggaaggggctggagtgg attggatgcattagtgctggtggtggtagcacagactacgcgaactgggtg aatggccgattcactctctccagagacatcgaccagagcacaggttgcctt caactgaacagtctgacagacgcggacacggccatgtattactgtgcggga aatctagagatctggggccaagggaccctggtcaccgtctcgagc.

In another embodiment of the invention, polynucleotides of the invention comprise, or alternatively consist of, the following polynucleotide sequence encoding the heavy chain constant region polypeptide sequence of SEQ ID NO: 810:

(SEQ ID NO: 820)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca

```
acgtgaatcacaagcccagcaacaccaaggtggacgcgagagttgagccc aaatcttgtgacaaaactcacacatgcccaccgtgcccagcacctgaact cctgggggaccgtcagtcttcctcttcccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.
```

In another embodiment of the invention, polynucleotides comprise, or alternatively consist of, the polynucleotide sequence of SEQ ID NO: 831 which encodes the light chain polypeptide sequence of SEQ ID NO: 821 and which consists of the light chain variable region coding sequence of SEQ ID NO: 832 and the light chain constant region coding sequence of SEQ ID NO: 840.

In another embodiment of the invention, polynucleotides of the invention comprise, or alternatively consist of, the following polynucleotide sequence encoding the light chain variable region polypeptide sequence of SEQ ID NO: 822:

```
                                        (SEQ ID NO: 832)
gcccaagtgctgacccagactccatcctccgtgtctgcagctgtgggagg cacagtcaccatcaattgccagtccagtccgagtatttatagtggcgcct ttttatcctggtttcagcagaaaccagggcagcctcccaagttcctgatc tacgaagcctccaaactggcatctggggtcccatcgcggttcagtggcag tggatctgggacacagttcactctcaccatcagcgacgtacagtgtgacg atgctgccacttactactgtctaggcttttatgattgtagcagtgttgat tgccatgctttcggcggagggaccgaggtggtggtcaaacgt.
```

In another embodiment of the invention, polynucleotides of the invention comprise, or alternatively consist of, the following polynucleotide sequence encoding the light chain constant region polypeptide sequence of SEQ ID NO: 830:

```
                                        (SEQ ID NO: 840)
acggtagcggccccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct
```

```
acgcctgcgaagtcacccatcagggcctgagctcgcccgtcacaaagagc ttcaacaggggagagtgt.
```

In a further embodiment of the invention, polynucleotides encoding antigen-binding fragments having binding specificity to PACAP comprise, or alternatively consist of, one or more of the polynucleotide sequences of SEQ ID NO: 814; SEQ ID NO: 816; and SEQ ID NO: 818, which correspond to polynucleotides encoding the CDRs (hypervariable regions) of the heavy chain sequence of SEQ ID NO: 801, or the heavy chain variable region sequence of SEQ ID NO: 802, and/or one or more of the polynucleotide sequences of SEQ ID NO: 834; SEQ ID NO: 836; and SEQ ID NO: 838, which correspond to the CDRs (hypervariable regions) of the light chain sequence of SEQ ID NO: 821, or the light chain variable region sequence of SEQ ID NO: 822, or combinations of these polynucleotide sequences. In another embodiment of the invention, the polynucleotides encoding the antibodies of the invention or antigen-binding fragments thereof comprise, or alternatively consist of, combinations of polynucleotides encoding one or more of the CDRs, the heavy chain variable region and light chain variable region sequences, and the heavy chain and light chain sequences set forth above, including all of them.

In a further embodiment of the invention, polynucleotides encoding antigen-binding fragments having binding specificity to PACAP comprise, or alternatively consist of, one or more of the polynucleotide sequences of SEQ ID NO: 813; SEQ ID NO: 815; SEQ ID NO: 817; and SEQ ID NO: 819, which correspond to polynucleotides encoding the FRs (constant regions) of the heavy chain sequence of SEQ ID NO: 801, or the heavy chain variable region sequence of SEQ ID NO: 802, and/or one or more of the polynucleotide sequences of SEQ ID NO: 833; SEQ ID NO: 835; SEQ ID NO: 837; and SEQ ID NO: 839, which correspond to the FRs (constant regions) of the light chain sequence of SEQ ID NO: 821, or the light chain variable region sequence of SEQ ID NO: 822, or combinations of these polynucleotide sequences. In another embodiment of the invention, the polynucleotides encoding the antibodies of the invention or fragments thereof comprise, or alternatively consist of, combinations of one or more of the FRs, the heavy chain variable region and light chain variable region sequences, and the heavy chain and light chain sequences set forth above, including all of them.

The invention also contemplates polynucleotide sequences including one or more of the polynucleotide sequences encoding antigen-binding fragments described herein. In one embodiment of the invention, polynucleotides encoding antigen-binding fragments having binding specificity to PACAP comprise, or alternatively consist of, one, two, three or more, including all of the following polynucleotides encoding antigen-binding fragments: the polynucleotide SEQ ID NO: 811 encoding the heavy chain sequence of SEQ ID NO: 801; the polynucleotide SEQ ID NO: 812 encoding the heavy chain variable region sequence of SEQ ID NO: 802; the polynucleotide SEQ ID NO: 831 encoding the light chain sequence of SEQ ID NO: 821; the polynucleotide SEQ ID NO: 832 encoding the light chain variable region sequence of SEQ ID NO: 822; polynucleotides encoding the CDRs (SEQ ID NO: 814; SEQ ID NO: 816; and SEQ ID NO: 818) of the heavy chain sequence of SEQ ID NO: 801, or the heavy chain variable region sequence of SEQ ID NO: 802; polynucleotides encoding the CDRs (SEQ ID NO: 834; SEQ ID NO: 836; and SEQ ID NO: 838) of the light chain sequence of SEQ ID NO: 821, or the light chain variable region sequence of SEQ ID NO: 822; polynucleotides encoding the FRs (SEQ ID NO: 813; SEQ ID NO: 815; SEQ ID NO: 817; and SEQ ID NO: 819) of the heavy chain sequence of SEQ ID NO: 801, or the heavy chain variable region sequence of SEQ ID NO: 802; and polynucleotides encoding the FRs (SEQ ID NO: 833; SEQ ID NO: 835; SEQ ID NO: 837; and SEQ ID NO: 839) of the light chain sequence of SEQ ID NO: 821, or the light chain variable region sequence of SEQ ID NO: 822.

In another embodiment of the invention, polynucleotides of the invention comprise, or alternatively consist of, polynucleotides encoding Fab fragments having binding specificity for PACAP. With respect to antibody Ab9, the polynucleotides encoding the full length Ab9 antibody comprise, or alternatively consist of, the polynucleotide SEQ ID NO: 811 encoding the heavy chain sequence of SEQ ID NO: 801, and the polynucleotide SEQ ID NO: 831 encoding the light chain sequence of SEQ ID NO: 821.

Another embodiment of the invention contemplates these polynucleotides incorporated into an expression vector for expression in mammalian cells such as CHO, NSO, or HEK-293 cells, or in fungal, insect, or microbial systems such as yeast cells such as the yeast *Pichia*. Suitable *Pichia* species include, but are not limited to, *Pichia pastoris*. In one embodiment of the invention described herein, Fab fragments can be produced by enzymatic digestion (e.g., papain) of Ab9 following expression of the full-length polynucleotides in a suitable host. In another embodiment of the invention, anti-PACAP antibodies, such as Ab9 or Fab fragments thereof, can be produced via expression of Ab9 polynucleotides in mammalian cells such as CHO, NSO, or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab9.H

In one embodiment, the invention is further directed to polynucleotides encoding antibody polypeptides having binding specificity to PACAP. In one embodiment of the invention, polynucleotides of the invention comprise, or alternatively consist of, the polynucleotide sequence of SEQ ID NO: 1171 which encodes the heavy chain sequence of SEQ ID NO: 1161 and which consists of the heavy chain variable region coding sequence of SEQ ID NO: 1172 and the heavy chain constant region coding sequence of SEQ ID NO: 1180.

In another embodiment of the invention, the polynucleotides of the invention comprise, or alternatively consist of, the following polynucleotide sequence encoding the heavy chain variable region polypeptide sequence of SEQ ID NO: 1162:

(SEQ ID NO: 1172)
gaggtgcagcttgtggagtagggggaggcttggtccagcctgggggtcc ctgagactacctgtgcagcctaggattcaccgtcagtagggactactgga tatgttgggtccgtcaggctccagggaaggggctggagtggattggatgc attagtgctggtggtggtagcacagactacgcgaactgggtgaatggccg attcaccataccagagacataccaagaacaccggttatcttcaaatgaac agcctgagagctgaggacactgctgtgtattactgtgcgggaaatctaga gatctggggccaagggaccctcgtcaccgtctcgagc.

In another embodiment of the invention, polynucleotides of the invention comprise, or alternatively consist of, the following polynucleotide sequence encoding the heavy chain constant region polypeptide sequence of SEQ ID NO: 1170:

(SEQ ID NO: 1180)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagaaagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides comprise, or alternatively consist of, the polynucleotide sequence of SEQ ID NO: 1191 which encodes the light chain polypeptide sequence of SEQ ID NO: 1181 and which consists of the light chain variable region coding sequence of SEQ ID NO: 1192 and the light chain constant region coding sequence of SEQ ID NO: 1200.

In another embodiment of the invention, polynucleotides of the invention comprise, or alternatively consist of, the following polynucleotide sequence encoding the light chain variable region polypeptide sequence of SEQ ID NO: 1182:

(SEQ ID NO: 1192)
gacatccagatgacccagtctccttccaccctgtctgcatctgtaggaga cagagtcaccatcacttgtcagtccagtccgagtatctatagtggcgcct tcttatcctggtatcagcagaaaccaggaaaagcccctaagttcctgatc tatgaagcctccaaactggcatctggagtcccatcaaggttcagcggcag tggatctggaacagaattcactctcaccatcagcagcctgcagcctgatg attttgcaacttactactgtctaggatctatgattgtagcagtgttgatt gccatgattcggcggaggaaccaaggtggaaatcaaacgt.

In another embodiment of the invention, polynucleotides of the invention comprise, or alternatively consist of, the following polynucleotide sequence encoding the light chain constant region polypeptide sequence of SEQ ID NO: 1190:

```
                                              (SEQ ID NO: 1200)
acggtagcggccccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.
```

In a further embodiment of the invention, polynucleotides encoding antigen-binding fragments having binding specificity to PACAP comprise, or alternatively consist of, one or more of the polynucleotide sequences of SEQ ID NO: 1174; SEQ ID NO: 1176; and SEQ ID NO: 1178, which correspond to polynucleotides encoding the CDRs (hypervariable regions) of the heavy chain sequence of SEQ ID NO: 1161, or the heavy chain variable region sequence of SEQ ID NO: 1162, and/or one or more of the polynucleotide sequences of SEQ ID NO: 1194; SEQ ID NO: 1196; and SEQ ID NO: 1198, which correspond to the CDRs (hypervariable regions) of the light chain sequence of SEQ ID NO: 1181, or the light chain variable region sequence of SEQ ID NO: 1182, or combinations of these polynucleotide sequences. In another embodiment of the invention, the polynucleotides encoding the antibodies of the invention or antigen-binding fragments thereof comprise, or alternatively consist of, combinations of polynucleotides encoding one or more of the CDRs, the heavy chain variable region and light chain variable region sequences, and the heavy chain and light chain sequences set forth above, including all of them.

In a further embodiment of the invention, polynucleotides encoding antigen-binding fragments having binding specificity to PACAP comprise, or alternatively consist of, one or more of the polynucleotide sequences of SEQ ID NO: 1173; SEQ ID NO: 1175; SEQ ID NO: 1177; and SEQ ID NO: 1179, which correspond to polynucleotides encoding the FRs (constant regions) of the heavy chain sequence of SEQ ID NO: 1161, or the heavy chain variable region sequence of SEQ ID NO: 1162, and/or one or more of the polynucleotide sequences of SEQ ID NO: 1193; SEQ ID NO: 1195; SEQ ID NO: 1197; and SEQ ID NO: 1199, which correspond to the FRs (constant regions) of the light chain sequence of SEQ ID NO: 1181, or the light chain variable region sequence of SEQ ID NO: 1182, or combinations of these polynucleotide sequences. In another embodiment of the invention, the polynucleotides encoding the antibodies of the invention or fragments thereof comprise, or alternatively consist of, combinations of one or more of the FRs, the heavy chain variable region and light chain variable region sequences, and the heavy chain and light chain sequences set forth above, including all of them.

The invention also contemplates polynucleotide sequences including one or more of the polynucleotide sequences encoding antigen-binding fragments described herein. In one embodiment of the invention, polynucleotides encoding antigen-binding fragments having binding specificity to PACAP comprise, or alternatively consist of, one, two, three or more, including all of the following polynucleotides encoding antigen-binding fragments: the polynucleotide SEQ ID NO: 1171 encoding the heavy chain sequence of SEQ ID NO: 1161; the polynucleotide SEQ ID NO: 1172 encoding the heavy chain variable region sequence of SEQ ID NO: 1162; the polynucleotide SEQ ID NO: 1191 encoding the light chain sequence of SEQ ID NO: 1181; the polynucleotide SEQ ID NO: 1192 encoding the light chain variable region sequence of SEQ ID NO: 1182; polynucleotides encoding the CDRs (SEQ ID NO: 1174; SEQ ID NO: 1176; and SEQ ID NO: 1178) of the heavy chain sequence of SEQ ID NO: 1161, or the heavy chain variable region sequence of SEQ ID NO: 1162; polynucleotides encoding the CDRs (SEQ ID NO: 1194; SEQ ID NO: 1196; and SEQ ID NO: 1198) of the light chain sequence of SEQ ID NO: 1181, or the light chain variable region sequence of SEQ ID NO: 1182; polynucleotides encoding the FRs (SEQ ID NO: 1173; SEQ ID NO: 1175; SEQ ID NO: 1177; and SEQ ID NO: 1179) of the heavy chain sequence of SEQ ID NO: 1161, or the heavy chain variable region sequence of SEQ ID NO: 1162; and polynucleotides encoding the FRs (SEQ ID NO: 1193; SEQ ID NO: 1195; SEQ ID NO: 1197; and SEQ ID NO: 1199) of the light chain sequence of SEQ ID NO: 1181, or the light chain variable region sequence of SEQ ID NO: 1182.

In another embodiment of the invention, polynucleotides of the invention comprise, or alternatively consist of, polynucleotides encoding Fab fragments having binding specificity for PACAP. With respect to antibody Ab9.H, the polynucleotides encoding the full length Ab9.H antibody comprise, or alternatively consist of, the polynucleotide SEQ ID NO: 1171 encoding the heavy chain sequence of SEQ ID NO: 1161, and the polynucleotide SEQ ID NO: 1191 encoding the light chain sequence of SEQ ID NO: 1181.

Another embodiment of the invention contemplates these polynucleotides incorporated into an expression vector for expression in mammalian cells such as CHO, NSO, or HEK-293 cells, or in fungal, insect, or microbial systems such as yeast cells such as the yeast *Pichia*. Suitable *Pichia* species include, but are not limited to, *Pichia pastoris*. In one embodiment of the invention described herein, Fab fragments can be produced by enzymatic digestion (e.g., papain) of Ab9.H following expression of the full-length polynucleotides in a suitable host. In another embodiment of the invention, anti-PACAP antibodies, such as Ab9.H or Fab fragments thereof, can be produced via expression of Ab9.H polynucleotides in mammalian cells such as CHO, NSO, or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab12.H

In one embodiment, the invention is further directed to polynucleotides encoding antibody polypeptides having binding specificity to PACAP. In one embodiment of the invention, polynucleotides of the invention comprise, or alternatively consist of, the polynucleotide sequence of SEQ ID NO: 1051 which encodes the heavy chain sequence of SEQ ID NO: 1041 and which consists of the heavy chain variable region coding sequence of SEQ ID NO: 1052 and the heavy chain constant region coding sequence of SEQ ID NO: 1060.

In another embodiment of the invention, the polynucleotides of the invention comprise, or alternatively consist of, the following polynucleotide sequence encoding the heavy chain variable region polypeptide sequence of SEQ ID NO: 1042:

(SEQ ID NO: 1052)
gaggtgcagcttgtggagtagggggaggcttggtccagcctggggggtcc ctgagactacctgtgcagcctaggattaccctcagtagctatgcaatggg ctgggtccgtcaggctccagggaagggctggagtggatcggagacatta gtacttatggtaccacagactacgcgagagggtgtatggccgattcacca taccagagacaattccaagaacaccgtgtatcttcaaatgaacagcctga gagctgaggacactgctgtgtatttctgtgctagagactattggttgagc ttgtggggccaagggaccctcgtcaccgtctcgagc.

In another embodiment of the invention, polynucleotides of the invention comprise, or alternatively consist of, the following polynucleotide sequence encoding the heavy chain constant region polypeptide sequence of SEQ ID NO: 1050:

(SEQ ID NO: 1060)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagaaagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagcctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides comprise, or alternatively consist of, the polynucleotide sequence of SEQ ID NO: 1071 which encodes the light chain polypeptide sequence of SEQ ID NO: 1061 and which consists of the light chain variable region coding sequence of SEQ ID NO: 1072 and the light chain constant region coding sequence of SEQ ID NO: 1080.

In another embodiment of the invention, polynucleotides of the invention comprise, or alternatively consist of, the following polynucleotide sequence encoding the light chain variable region polypeptide sequence of SEQ ID NO: 1062:

(SEQ ID NO: 1072)
gcagcccagctgacccagtctccttccaccctgtctgcatctgtaggaga cagagtcaccatcacttgtcagtccagtcagagtgtttatgataacaatg attagcctggtatcagcagaaaccaggaaaagcccctaagctcctgatct atgctgcatccactctggcatctggagtcccatcaaggttcagcggcagt ggatctggaacagaattcactctcaccatcagcagcctgcagcctgatga tttttgcaacttactactgtctaggcggttattatgatcctgctgataatg ctttcggcggaggaaccaaggtggaaatcaaacgt.

In another embodiment of the invention, polynucleotides of the invention comprise, or alternatively consist of, the following polynucleotide sequence encoding the light chain constant region polypeptide sequence of SEQ ID NO: 1070:

(SEQ ID NO: 1080)
acggtagcggcccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antigen-binding fragments having binding specificity to PACAP comprise, or alternatively consist of, one or more of the polynucleotide sequences of SEQ ID NO: 1054; SEQ ID NO: 1056; and SEQ ID NO: 1058, which correspond to polynucleotides encoding the CDRs (hypervariable regions) of the heavy chain sequence of SEQ ID NO: 1041, or the heavy chain variable region sequence of SEQ ID NO: 1042, and/or one or more of the polynucleotide sequences of SEQ ID NO: 1074; SEQ ID NO: 1076; and SEQ ID NO: 1078, which correspond to the CDRs (hypervariable regions) of the light chain sequence of SEQ ID NO: 1061, or the light chain variable region sequence of SEQ ID NO: 1062, or combinations of these polynucleotide sequences. In another embodiment of the invention, the polynucleotides encoding the antibodies of the invention or antigen-binding fragments thereof comprise, or alternatively consist of, combinations of polynucleotides encoding one or more of the CDRs, the heavy chain variable region and light chain variable region sequences, and the heavy chain and light chain sequences set forth above, including all of them.

In a further embodiment of the invention, polynucleotides encoding antigen-binding fragments having binding specificity to PACAP comprise, or alternatively consist of, one or more of the polynucleotide sequences of SEQ ID NO: 1053; SEQ ID NO: 1055; SEQ ID NO: 1057; and SEQ ID NO: 1059, which correspond to polynucleotides encoding the FRs (constant regions) of the heavy chain sequence of SEQ ID NO: 1041, or the heavy chain variable region sequence of SEQ ID NO: 1042, and/or one or more of the polynucleotide sequences of SEQ ID NO: 1073; SEQ ID NO: 1075; SEQ ID NO: 1077; and SEQ ID NO: 1079, which correspond to the FRs (constant regions) of the light chain sequence of SEQ ID NO: 1061, or the light chain variable region sequence of SEQ ID NO: 1062, or combinations of these polynucleotide sequences. In another embodiment of the invention, the polynucleotides encoding the antibodies of the invention or fragments thereof comprise, or alternatively consist of, combinations of one or more of the FRs, the heavy chain variable region and light chain variable region sequences, and the heavy chain and light chain sequences set forth above, including all of them.

The invention also contemplates polynucleotide sequences including one or more of the polynucleotide sequences encoding antigen-binding fragments described herein. In one embodiment of the invention, polynucleotides encoding antigen-binding fragments having binding specificity to PACAP comprise, or alternatively consist of, one, two, three or more, including all of the following polynucleotides encoding antigen-binding fragments: the polynucleotide SEQ ID NO: 1051 encoding the heavy chain sequence of SEQ ID NO: 1041; the polynucleotide SEQ ID NO: 1052 encoding the heavy chain variable region sequence of SEQ ID NO: 1042; the polynucleotide SEQ ID NO: 1071 encoding the light chain sequence of SEQ ID NO: 1061; the polynucleotide SEQ ID NO: 1072 encoding the light chain variable region sequence of SEQ ID NO: 1062; polynucleotides encoding the CDRs (SEQ ID NO: 1054; SEQ ID NO: 1056; and SEQ ID NO: 1058) of the heavy chain sequence of SEQ ID NO: 1041, or the heavy chain variable region sequence of SEQ ID NO: 1042; polynucleotides encoding the CDRs (SEQ ID NO: 1074; SEQ ID NO: 1076; and SEQ ID NO: 1078) of the light chain sequence of SEQ ID NO: 1061, or the light chain variable region sequence of SEQ ID NO: 1062; polynucleotides encoding the FRs (SEQ ID NO: 1053; SEQ ID NO: 1055; SEQ ID NO: 1057; and SEQ ID NO: 1059) of the heavy chain sequence of SEQ ID NO: 1041, or the heavy chain variable region sequence of SEQ ID NO: 1042; and polynucleotides encoding the FRs (SEQ ID NO: 1073; SEQ ID NO: 1075; SEQ ID NO: 1077; and SEQ ID NO: 1079) of the light chain sequence of SEQ ID NO: 1061, or the light chain variable region sequence of SEQ ID NO: 1062.

In another embodiment of the invention, polynucleotides of the invention comprise, or alternatively consist of, polynucleotides encoding Fab fragments having binding specificity for PACAP. With respect to antibody Ab12.H, the polynucleotides encoding the full length Ab12.H antibody comprise, or alternatively consist of, the polynucleotide SEQ ID NO: 1051 encoding the heavy chain sequence of SEQ ID NO: 1041, and the polynucleotide SEQ ID NO: 1071 encoding the light chain sequence of SEQ ID NO: 1061.

Another embodiment of the invention contemplates these polynucleotides incorporated into an expression vector for expression in mammalian cells such as CHO, NSO, or HEK-293 cells, or in fungal, insect, or microbial systems such as yeast cells such as the yeast *Pichia*. Suitable *Pichia* species include, but are not limited to, *Pichia pastoris*. In one embodiment of the invention described herein, Fab fragments can be produced by enzymatic digestion (e.g., papain) of Ab12.H following expression of the full-length polynucleotides in a suitable host. In another embodiment of the invention, anti-PACAP antibodies, such as Ab12.H or Fab fragments thereof, can be produced via expression of Ab12.H polynucleotides in mammalian cells such as CHO, NSO, or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Host cells and vectors comprising said polynucleotides are also contemplated.

The invention further contemplates vectors comprising the polynucleotide sequences encoding the heavy chain variable region and light chain variable region polypeptide sequences, as well as the individual CDRs (hypervariable regions), as set forth herein, as well as host cells comprising said vector sequences. In embodiments of the invention, the host cells are mammalian cells, such as CHO cells. In embodiments of the invention, the host cells are yeast cells, such as yeast cells of the genus *Pichia*.

B-cell Screening and Isolation

In one embodiment, the present invention contemplates the preparation and isolation of a clonal population of antigen-specific B-cells that may be used for isolating at least one PACAP antigen-specific cell, which can be used to produce a monoclonal antibody against PACAP, which is specific to a desired PACAP antigen, or a nucleic acid sequence corresponding to such an antibody. Methods of preparing and isolating said clonal population of antigen-specific B-cells are taught, for example, in U.S. Patent Publication No. US2007/0269868 to Carvalho-Jensen et al., the disclosure of which is herein incorporated by reference in its entirety. Methods of preparing and isolating said clonal population of antigen-specific B-cells are also taught herein in the examples. Methods of "enriching" a cell population by size or density are known in the art. See, e.g., U.S. Pat. No. 5,627,052. These steps can be used in addition to enriching the cell population by antigen-specificity.

Methods of Humanizing Antibodies

In another embodiment, the present invention contemplates methods for humanizing antibody heavy and light chains. Methods for humanizing antibody heavy and light chains that may be applied to anti-PACAP antibodies are taught, for example, in U.S. Patent Publication No. US2009/0022659 to Olson et al., and in U.S. Pat. No. 7,935,340 to Garcia-Martinez et al., the disclosures of each of which are herein incorporated by reference in their entireties.

Methods of Producing Antibodies and Fragments Thereof

In another embodiment, the present invention contemplates methods for producing anti-PACAP antibodies and fragments thereof. Methods for producing anti-PACAP antibodies and fragments thereof secreted from polyploidal, preferably diploid or tetraploid strains of mating competent yeast are taught, for example, in U.S. Patent Publication No. US2009/0022659 to Olson et al., and in U.S. Pat. No. 7,935,340 to Garcia-Martinez et al., the disclosures of each of which are herein incorporated by reference in their entireties.

Other methods of producing antibodies are well known to those of ordinary skill in the art. For example, methods of producing chimeric antibodies are now well known in the art (See, for example, U.S. Pat. No. 4,816,567 to Cabilly et al.; Morrison et al., *Proc. Natl. Acad. Sci. U.S.A.,* 81:8651-55 (1984); Neuberger et al., *Nature,* 314:268-270 (1985); Boulianne, G. L. et al., *Nature,* 312:643-46 (1984), the disclosures of each of which are herein incorporated by reference in their entireties).

Likewise, other methods of producing humanized antibodies are now well known in the art (See, for example, U.S. Pat. Nos. 5,530,101, 5,585,089, 5,693,762, and 6,180,370 to Queen et al; U.S. Pat. Nos. 5,225,539 and 6,548,640 to Winter; U.S. Pat. Nos. 6,054,297, 6,407,213 and 6,639,055 to Carter et al; U.S. Pat. No. 6,632,927 to Adair; Jones, P. T. et al., *Nature,* 321:522-525 (1986); Reichmann, L. et al., *Nature,* 332:323-327 (1988); Verhoeyen, M. et al., *Science,* 239:1534-36 (1988), the disclosures of each of which are herein incorporated by reference in their entireties).

Antibody polypeptides of the invention having PACAP binding specificity may also be produced by constructing, using conventional techniques well known to those of ordinary skill in the art, an expression vector containing a promoter (optionally as a component of a eukaryotic or prokaryotic operon) and a DNA sequence encoding an antibody heavy chain in which the DNA sequence encoding the CDRs required for antibody specificity is derived from a non-human cell source, preferably a rabbit B-cell source, while the DNA sequence encoding the remaining parts of the antibody chain is derived from a human cell source.

A second expression vector is produced using the same conventional means well known to those of ordinary skill in the art, said expression vector containing a promoter (optionally as a component of a eukaryotic or prokaryotic operon) and a DNA sequence encoding an antibody light chain in which the DNA sequence encoding the CDRs required for antibody specificity is derived from a non-human cell source, preferably a rabbit B-cell source, while the DNA sequence encoding the remaining parts of the antibody chain is derived from a human cell source.

The expression vectors are transfected into a host cell by convention techniques well known to those of ordinary skill in the art to produce a transfected host cell, said transfected host cell cultured by conventional techniques well known to those of ordinary skill in the art to produce said antibody polypeptides.

The host cell may be co-transfected with the two expression vectors described above, the first expression vector containing DNA encoding a promoter (optionally as a component of a eukaryotic or prokaryotic operon) and a light chain-derived polypeptide and the second vector containing DNA encoding a promoter (optionally as a component of a eukaryotic or prokaryotic operon) and a heavy chain-derived polypeptide. The two vectors contain different selectable markers, but preferably achieve substantially equal expression of the heavy and light chain polypeptides. Alternatively, a single vector may be used, the vector including DNA encoding both the heavy and light chain polypeptides. The coding sequences for the heavy and light chains may comprise cDNA, genomic DNA, or both.

The host cells used to express the antibody polypeptides may be either a bacterial cell such as *E. coli*, or a eukaryotic cell such as *P. pastoris*. In one embodiment of the invention, a mammalian cell of a well-defined type for this purpose, such as a myeloma cell, a CHO cell line, a NSO cell line, or a HEK293 cell line may be used.

The general methods by which the vectors may be constructed, transfection methods required to produce the host cell and culturing methods required to produce the antibody polypeptides from said host cells all include conventional techniques. Although preferably the cell line used to produce the antibody is a mammalian cell line, any other suitable cell line, such as a bacterial cell line such as an *E. coli*-derived bacterial strain, or a yeast cell line, may alternatively be used.

Similarly, once produced the antibody polypeptides may be purified according to standard procedures in the art, such as for example cross-flow filtration, ammonium sulphate precipitation, affinity column chromatography, hydrophobic interaction chromatography ("HIC"), and the like.

The antibody polypeptides described herein may also be used for the design and synthesis of either peptide or non-peptide mimetics that would be useful for the same therapeutic applications as the antibody polypeptides of the invention (See, for example, Saragobi et al., *Science,* 253: 792-795 (1991), the contents of which are herein incorporated by reference in its entirety).

Screening Assays

The screening assays described here are designed to identify high affinity anti-PACAP Abs which may be useful in the treatment of diseases and disorders associated with PACAP in subjects exhibiting symptoms of a PACAP associated disease or disorder.

In some embodiments, the antibody is used as a diagnostic tool. The antibody can be used to assay the amount of PACAP present in a sample and/or subject. As will be appreciated by one of skill in the art, such antibodies need not be neutralizing antibodies. In some embodiments, the diagnostic antibody is not a neutralizing antibody. In some embodiments, the diagnostic antibody binds to a different epitope than the neutralizing antibody binds to. In some embodiments, the two antibodies do not compete with one another.

In some embodiments, the antibodies disclosed herein are used or provided in an assay kit and/or method for the detection of PACAP in mammalian tissues or cells in order to screen/diagnose for a disease or disorder associated with changes in levels of PACAP. The kit comprises an antibody that binds PACAP and means for indicating the binding of the antibody with PACAP, if present, and optionally PACAP protein levels. Various means for indicating the presence of an antibody can be used. For example, fluorophores, other molecular probes, or enzymes can be linked to the antibody and the presence of the antibody can be observed in a variety of ways. The method for screening for such disorders can involve the use of the kit, or simply the use of one of the disclosed antibodies and the determination of whether the antibody binds to PACAP in a sample. As will be appreciated by one of skill in the art, high or elevated levels of PACAP will result in larger amounts of the antibody binding to PACAP in the sample. Thus, degree of antibody binding can be used to determine how much PACAP is in a sample. Subjects or samples with an amount of PACAP that is greater than a predetermined amount (e.g., an amount or range that a person without a PACAP-related disorder would have) can be characterized as having a PACAP-mediated disorder, e.g., migraine, headache, pain, or other condition.

The present invention further provides for a kit for detecting binding of an anti-PACAP antibody of the invention to PACAP. In particular, the kit may be used to detect the presence of PACAP specifically reactive with an anti-PACAP antibody of the invention or an immunoreactive fragment thereof. The kit may also include an antibody bound to a substrate, a secondary antibody reactive with the antigen and a reagent for detecting a reaction of the secondary antibody with the antigen. Such a kit may be an ELISA kit and can comprise the substrate, primary and secondary antibodies when appropriate, and any other necessary reagents such as detectable moieties, enzyme substrates, and color reagents, for example as described herein. The diagnostic kit may also be in the form of an immunoblot kit. The diagnostic kit may also be in the form of a chemiluminescent kit (Meso Scale Discovery, Gaithersburg, Md.). The diagnostic kit may also be a lanthanide-based detection kit (PerkinElmer, San Jose, Calif.).

A skilled clinician would understand that a biological sample includes, but is not limited to, sera, plasma, urine, saliva, mucous, pleural fluid, synovial fluid, and spinal fluid.

Methods of Ameliorating or Reducing Symptoms of, or Treating, or Preventing, Diseases and Disorders Associated with PACAP In another embodiment of the invention, anti-PACAP antibodies described herein, or antigen binding fragments thereof, are useful for ameliorating or reducing the symptoms of, or treating, or preventing, diseases and disorders associated with PACAP. Anti-PACAP antibodies described herein, or antigen binding fragments thereof, as well as combinations, can also be administered in a therapeutically effective amount to patients in need of treatment of diseases and disorders associated with PACAP in the form of a pharmaceutical composition as described in greater detail below.

In another embodiment of the invention, anti-PACAP antibodies described herein, or antigen binding fragments thereof, are useful (either alone or in combination with another agent) for ameliorating or reducing the symptoms of, or treating, or preventing a disease or condition associated with PACAP.

In another embodiment of the invention, anti-PACAP antibodies described herein, or antigen binding fragments thereof, with or without a second agent, are useful for ameliorating or reducing the symptoms of, or treating, or preventing, the following non-limiting listing of diseases and disorders: migraine (with or without aura), hemiplegic migraines, cluster headaches, migrainous neuralgia, chronic headaches, tension headaches, general headaches, hot flush, photophobia, chronic paroxysmal hemicrania, secondary headaches due to an underlying structural problem in the head or neck, cranial neuralgia, sinus headaches (e.g., headache associated with sinusitis), allergy-induced headaches or migraines, pain, chronic pain, neuroinflammatory or inflammatory pain, post-operative incision pain, post-surgical pain, trauma-related pain, eye pain, tooth pain, complex regional pain syndrome, cancer pain (e.g., primary or metastatic bone cancer pain), fracture pain, osteoporotic fracture pain, pain resulting from burn, gout joint pain, pain associated with sickle cell crises, pain associated with temporomandibular disorders, cirrhosis, hepatitis, neurogenic pain, neuropathic pain, nociceptic pain, visceral pain, trigeminal neuralgia, post-herpetic neuralgia, phantom limb pain, fibromyalgia, menstrual pain, ovarialgia, reflex sympathetic dystrophy, osteoarthritis or rheumatoid arthritis pain, lower back pain, diabetic neuropathy, sciatica, dyspepsia, irritable bowel syndrome, inflammatory bowel disease, Crohn's disease, ileitis, ulcerative colitis, renal colic, dysmenorrhea, cystitis, interstitial cystitis, menstrual period, labor, menopause, pancreatitis, schizophrenia, depression, post-traumatic stress disorder, anxiety disorders, diabetes, autoimmune diabetes, endothelial dysfunction, ischemia, Raynaud's syndrome, coronary heart disease ("CHD"), coronary artery disease ("CAD"), heart failure, peripheral arterial disease ("PAD"), pulmonary hypertension ("PH"), connective tissue disorders, stroke, Sjögren's syndrome, multiple sclerosis, bronchial hyperreactivity, asthma, bronchitis, bronchodilation, emphysema, chronic obstructive pulmonary disease ("COPD"), inflammatory dermatitis, adenocarcinoma in glandular tissue, blastoma in embryonic tissue of organs, carcinoma in epithelial tissue, leukemia in tissues that form blood cells, lymphoma in lymphatic tissue, myeloma in bone marrow, sarcoma in connective or supportive tissue, adrenal cancer, AIDS-related lymphoma, anemia, bladder cancer, bone cancer, brain cancer, breast cancer, carcinoid tumors, cervical cancer, chemotherapy, colon cancer, cytopenia, endometrial cancer, esophageal cancer, gastric cancer, head cancer, neck cancer, hepatobiliary cancer, kidney cancer, leukemia, liver cancer, lung cancer, lymphoma, Hodgkin's disease, non-Hodgkin's, nervous system tumors, oral cancer, ovarian cancer, pancreatic cancer, prostate cancer, rectal cancer, skin cancer, stomach cancer, testicular cancer, thyroid cancer, urethral cancer, cancer of bone marrow, multiple myeloma, tumors that metastasize to the bone, tumors infiltrating the nerve and hollow viscus, tumors near neural structures, acne vulgaris, atopic dermatitis, urticaria, keloids, hypertrophic scars and rosacea, allergic dermatitis, psoriasis, pruritus, neurogenic cutaneous redness, erythema, weight loss, anorexia, sarcoidosis, shock, sepsis, opiate withdrawal syndrome, morphine tolerance, epilepsy, lower urinary tract ("LUT") disorders such as urinary tract infection, abnormal voiding, urinary urgency, nocturia, urinary incontinence, overactive bladder and for preventing or alleviating the pain associated with such LUT conditions. Preferably, the subject anti-PACAP antibodies and antigen binding fragments described herein are useful for ameliorating or reducing the symptoms of, treating, or preventing migraine, headache and a pain associated disease or condition.

In particular, the subject anti-PACAP antibodies and antigen binding fragments can also be useful for ameliorating or reducing the symptoms of, treating, or preventing photophobia, occurring with a headache and/or migraine as well as occurring independent of a headache and/or a migraine.

Migraineurs typically develop worsening pain and migraine symptoms when exposed to light, a phenomenon known as photophobia. Photophobia is also common in ocular disorders, such as iritis and uveitis, and intracranial disorders, such as meningitis. In the classic visual pathway, light activates rods and cones in the retina, which activate retinal ganglion cells that project via the optic nerve, to the lateral *geniculate* nucleus, superior colliculus, and then the visual cortex. This pathway includes image-forming and non-image-forming data. A new pathway (non-image-forming information) allows maintenance of normal circadian rhythms via the suprachiasmatic nucleus and is regulated by intrinsically photosensitive retinal ganglion cells (ipRGCs). These ipRGCs are independent of the rods and cones and contain melanopsin, a photopigment.

Noseda, R. et al., *Nat. Neurosci.*, 13:239-245 (2010) studied blind individuals who had migraine and correlated these findings with rat models involving tracing of ipRGC projections to areas in perception of pain from the dura. Of the blind patients with migraine, 6 had no light perception due to severe optic nerve damage or bilateral enucleation. These subjects experienced abnormal sleep patterns and poor pupillary light responses. Their migraines did not worsen with light exposure. In contrast, 14 blind subjects who were able to detect light despite minimal perception of images had normal sleep patterns and a normal pupillary light reflex. Despite widespread rod and cone degeneration, these patients had worsening migraine symptoms with light exposure during migraine attacks, suggesting that ipRGCs, and not rods and cones, are important in photophobia.

These retinal projections of non-image-forming brain areas project to the contralateral dorsocaudal region of the posterior thalamus, as demonstrated by anterograde tracing in the rat. ipRGC input to this area modulates dura-sensitive pain neurons, which also project to this region. Thalamic neurons, dually sensitive to dural pain and light input, project widely to multiple cortical regions, including the primary somatosensory cortex, the primary and secondary motor cortices, the parietal association cortex, and the primary and secondary visual cortices. These cortical projections may help explain other common migraine symptoms, in addition to photophobia, such as motor weakness or incoordination, visual disturbances, and poor concentration.

Photophobia also accompanies other less frequent but likewise disabling conditions, such as cluster headache and other trigeminal autonomic cephalalgias and blepharospasm. The mechanisms underlying photophobia involve the trigeminal system. Photophobia in blind patients suggests contributions from a nonvisual pathway. In addition, trigeminal autonomic cephalalgias, a less common group of primary headache disorders, are characterized by unilateral trigeminal-mediated pain frequently associated with ipsilateral photophobia.

Common causes of photophobia include migraine headaches, cataracts, or severe ophthalmologic diseases such as uveitis or corneal abrasion. A more extensive list of disorders associated with photophobia includes eye related causes such as achromatopsia, aniridia, anticholinergic drugs may cause photophobia by paralyzing the iris sphincter muscle, aphakia (absence of the lens of the eye), buphthalmos (abnormally narrow angle between the cornea and iris), cataracts, cone dystrophy, congenital abnormalities of the eye, viral conjunctivitis ("pink eye"), corneal abrasion, corneal dystrophy, corneal ulcer, disruption of the corneal epithelium, such as that caused by a corneal foreign body or keratitis, ectopia lentis, endophthalmitis, eye trauma caused by disease, injury, or infection such as chalazion, episcleritis, glaucoma, keratoconus, or optic nerve hypoplasia, hydrophthalmos, or congenital glaucoma iritis, optic neuritis, pigment dispersion syndrome, pupillary dilation (naturally or chemically induced), retinal detachment, scarring of the cornea or sclera and uveitis.

In addition, photophobia has nervous-system-related or neurological causes including: autism spectrum disorders, Chiari malformation, dyslexia, encephalitis including myalgic encephalomyelitis aka chronic fatigue syndrome, meningitis, subarachnoid hemorrhage, tumor of the posterior cranial fossa, as well as other causes such as ankylosing spondylitis, albinism, ariboflavinosis, benzodiazepines (long term use of or withdrawal from benzodiazepines), chemotherapy, chikungunya, cystinosis, Ehlers-Danlos syndrome, hangover, influenza, infectious mononucleosis, magnesium deficiency, mercury poisoning, migraine, rabies, and tyrosinemia type II, also known as "Richner-Hanhart syndrome".

Additionally, it is known that photophobia is elevated in depression, bipolar disorder and agoraphobia.

The subject anti-PACAP antibodies and antigen binding fragments described herein can be effective for treating or preventing photophobia in any of these conditions, preferably, in a subject with post-traumatic stress disorder ("PTSD") or in a subject with traumatic brain injury.

Headaches may be classified by cause, as discussed below.

Primary headaches. A primary headache is caused by problems with or overactivity of pain-sensitive structures in the head. A primary headache is generally not considered to be a symptom of an underlying disease. Instead, chemical activity in the brain, the nerves or blood vessels of the head outside the skull, or muscles of the head and neck, or some combination of these factors, may play a role in primary headaches. Some people may carry genes that make them more likely to develop such headaches. Exemplary common primary headaches include, but are not limited to, cluster headache; tension headache (or tension-type headache); and trigeminal autonomic cephalalgia ("TAC"), including paroxysmal hemicrania. There are other headache patterns that may be considered types of primary headache, e.g., chronic daily headaches, cough headaches, exercise headaches, and sex headaches. These headaches are less common and have distinct features, such as an unusual duration or pain associated with a certain activity. Although these headaches are generally considered primary, each of them could be a symptom of an underlying disease. Additionally, some primary headaches can be triggered by lifestyle factors, including: alcohol; certain foods (e.g., processed meats that contain nitrates); changes in sleep or lack of sleep; poor posture; skipped meals; and stress.

Secondary headaches. A secondary headache is a symptom of a disease that can activate the pain-sensitive nerves of the head. Any number of conditions, which can vary greatly in severity, may cause secondary headaches. Exemplary sources of secondary headaches include, but are not limited to, acute sinusitis; arterial tears (carotid or vertebral dissections); venous thrombosis in the brain; brain aneurysm; brain arteriovenous malformation; carbon monoxide poisoning; Chiari malformation; concussion; dehydration; dental problems; ear infection (middle ear); encephalitis; giant cell arteritis; glaucoma; hangovers; influenza (flu); intracranial hematoma; medications to treat other disorders; meningitis; monosodium glutamate ("MSG"); overuse of pain medication; panic attacks; post-concussion syndrome; pressure from tight-fitting headgear, e.g., helmet or goggles; pseudotumor cerebri; toxoplasmosis; and trigeminal neuralgia. Specific types of secondary headaches include, but are not limited to, external compression headaches (a result of pressure-causing headgear); ice cream headaches (commonly called "brain freeze"); rebound headaches (caused by overuse of pain medication); sinus headaches (caused by inflammation and congestion in sinus cavities); spinal headaches (caused by low levels of cerebrospinal fluid, possibly the result of trauma, spinal tap or spinal anesthesia); and thunderclap headaches (a group of disorders that involves sudden, severe headaches).

Exemplary, non-limiting pain associated diseases and disorders that can be treated and/or prevented by the administration of the anti-PACAP antibodies of the present invention include, pain resulting from any condition associated with neurogenic, neuropathic, inflammatory, or nociceptive pain. Preferably, the pain-associated disorder will be associated with increased PACAP at the pain site.

In certain embodiments, the pain associated disorder to be treated is cancer pain arising from malignancy or from cancer selected from one or more of: adenocarcinoma in glandular tissue, blastoma in embryonic tissue of organs, carcinoma in epithelial tissue, leukemia in tissues that form blood cells, lymphoma in lymphatic tissue, myeloma in bone marrow, sarcoma in connective or supportive tissue, adrenal cancer, AIDS-related lymphoma, anemia, bladder cancer, bone cancer, brain cancer, breast cancer, carcinoid tumors, cervical cancer, chemotherapy, colon cancer, cytopenia, endometrial cancer, esophageal cancer, gastric cancer, head cancer, neck cancer, hepatobiliary cancer, kidney cancer, leukemia, liver cancer, lung cancer, lymphoma, Hodgkin's disease, non-Hodgkin's, nervous system tumors, oral cancer, ovarian cancer, pancreatic cancer, prostate cancer, rectal cancer, skin cancer, stomach cancer, testicular cancer, thyroid cancer, urethral cancer, cancer of bone marrow, multiple myeloma, tumors that metastasize to the bone, tumors infiltrating the nerve and hollow viscus, tumors near neural structures. Further preferably the cancer pain comprises visceral pain, preferably visceral pain which arises from pancreatic cancer and/or metastases in the abdomen. Further preferably the cancer pain comprises somatic pain, preferably somatic pain due to one or more of metastasis in the bone, postsurgical pain, sarcomas cancer of the connective tissue, cancer of bone tissue, cancer of blood-forming cells of the bone marrow, multiple myeloma, leukemia, primary or secondary bone cancer.

In other embodiments, the pain associated condition to be treated is associated with neuropathic pain and included, by way of example, trigeminal neuralgia, post-herpetic neuralgia, phantom limb pain, fibromyalgia, and reflex sympathetic dystrophy are preferably treated.

Further exemplary pain associated diseases or conditions, include but are not limited to, general pain, chronic pain, inflammatory pain, post-operative incision pain, post-surgical pain, trauma-related pain, lower back pain, eye pain, tooth pain, complex regional pain syndrome, cancer pain (e.g., primary or metastatic bone cancer pain), fracture pain, osteoporotic fracture pain, pain resulting from burn, gout joint pain, pain associated with sickle cell crises, pain associated with temporomandibular disorders, cirrhosis, hepatitis, neurogenic pain, neuropathic pain, nociceptic pain, visceral pain, trigeminal neuralgia, post-herpetic neuralgia, phantom limb pain, fibromyalgia, menstrual pain, ovarialgia, reflex sympathetic dystrophy, osteoarthritis or rheumatoid arthritis pain, lower back pain, diabetic neuropathy, sciatica, dyspepsia, irritable bowel syndrome, inflammatory bowel disease, Crohn's disease, ileitis, ulcerative colitis, renal colic, dysmenorrhea, cystitis, interstitial cystitis, menstrual period, labor, menopause, pancreatitis, schizophrenia, depression, post-traumatic stress disorder, anxiety disorders, diabetes, autoimmune diabetes, endothelial dysfunction, ischemia, Raynaud's syndrome, coronary heart disease ("CHD"), coronary artery disease ("CAD"), heart failure, peripheral arterial disease ("PAD"), pulmonary hypertension ("PH"), connective tissue disorders, stroke, Sjögren's syndrome, multiple sclerosis, overactive bladder, bronchial hyperreactivity, asthma, bronchitis, bronchodilation, emphysema, chronic obstructive pulmonary disease ("COPD"), inflammatory dermatitis, acne vulgaris, atopic dermatitis, urticaria, keloids, hypertrophic scars and rosacea, allergic dermatitis, psoriasis, puritus, neurogenic cutaneous redness, erythema, sarcoidosis, shock, sepsis, and opiate withdrawal syndrome.

Thus, the present invention includes methods of treating, preventing, and/or ameliorating any disease or disorder associated with PACAP activity or PACAP upregulation (including any of the above mentioned exemplary pain associated diseases, disorders and conditions) through use of the antibodies and antigen binding fragments of the invention.

Also, the subject anti-PACAP antibodies and antigen binding fragments may be used alone or in conjunction with other active agents, e.g., opioids and non-opioid analgesics such as NSAIDs to elicit analgesia or to potentiate the efficacy of another analgesic.

The subject antibodies potentially may be combined with any opioid analgesic or NSAID or other analgesic, potentially another antibody or another biologic such as, e.g., an anti-NGF or anti-CGRP or anti-CGRP-R antibody or antibody fragment or NGF, CGRP or CGRP-R polypeptide fragment or conjugate, in order to increase or enhance pain management. This may allow for such analgesic compounds to be administered for longer duration or at reduced dosages thereby potentially alleviating adverse side effects associated therewith.

Of particular interest is the co-administration of the subject anti-PACAP antibodies and antibody fragments with an anti-CGRP antibody (e.g., ALD403) or anti-CGRP-R antibody or antibody fragment and, moreover, the use of the subject anti-PACAP antibodies and antibody fragments to treat subjects that previously received an anti-CGRP or anti-CGRP-R antibody or antibody fragment. For example, the previously treated subject (who previously received at least one anti-CGRP or anti-CGRP-R antibody or antibody fragment administration) may be a migraineur who did not adequately respond to anti-CGRP or anti-CGRP-R antibody treatment ("poor responder") and/or has elicited an immune response to the anti-CGRP or anti-CGRP-R antibody or antibody fragment.

Likewise, the co-administration of the subject anti-PACAP antibodies and antigen binding fragments with BOTOX® (Botulinum toxin) is also of particular interest, e.g., in treating a migraineur. In some instances, the migraineur may not have adequately responded to previous treatments ("poor responder") and/or has elicited an immune response to the previous treatment.

In some embodiments, aspirin and/or acetaminophen may be taken in conjunction with the subject anti-PACAP antibody or antigen binding fragment. Aspirin is another type of non-steroidal anti-inflammatory compound.

The subject to which the pharmaceutical formulation is administered can be, e.g., any human or non-human animal that is in need of such treatment, prevention and/or amelioration, or who would otherwise benefit from the inhibition or attenuation of PACAP-mediated activity. For example, the subject can be an individual that is diagnosed with, or who is deemed to be at risk of being afflicted by any of the aforementioned diseases or disorders. The present invention further includes the use of any of the pharmaceutical formulations disclosed herein in the manufacture of a medicament for the treatment, prevention and/or amelioration of any disease or disorder associated with PACAP activity (including any of the above mentioned exemplary diseases, disorders and conditions).

Administration

In one embodiment of the invention, the anti-PACAP antibodies described herein, or PACAP binding fragments thereof, as well as combinations of said antibodies or antigen binding fragments thereof, are administered to a subject at a concentration of between 0.1 mg/ml and about any one of 0.5, 1, 5, 10, 15 20, 25, 30, 35, 40, 45, 50, 55, 60, 65, 70, 75, 80, 85, 90, 95, 100, 110, 120, 130, 140, 150, 160, 170, 180, 190, or 200 mg/ml, +/−10% error.

In another embodiment of the invention, the anti-PACAP antibodies and fragments thereof described herein are administered to a subject at a dose of between about 0.01 and 100.0 or 200.0 mg/kg of body weight of the recipient subject. In certain embodiments, depending on the type and severity of the PACAP-related disease, about 1 µg/kg to 50 mg/kg (e.g., 0.1-20 mg/kg) of antibody is an initial candidate dosage for administration to the patient, whether, for example, by one or more separate administrations, or by continuous infusion. In another embodiment, about 1 µg/kg to 15 mg/kg (e.g., 0.1 mg/kg-10 mg/kg) of antibody is an initial candidate dosage for administration to the patient. A typical daily dosage might range from about 1 µg/kg to 100 mg/kg or more, depending on several factors, e.g., the particular mammal being treated, the clinical condition of the individual patient, the cause of the disorder, the site of delivery of the agent, the method of administration, the scheduling of administration, and other factors known to medical practitioners. However, other dosage regimens may be useful.

For example, in addition to the relative dosages (mg/kg) discussed herein, the subject anti-PACAP antibodies and antigen binding fragments thereof can be administered to a subject at an absolute dose (mg). Accordingly, in one embodiment of the invention, the anti-PACAP antibodies and antigen binding fragments thereof described herein are administered to a subject at a dose of between about 1 microgram and about 1000 milligrams regardless of the route of administration.

In a preferred embodiment of the invention, the anti-PACAP antibodies described herein, or anti-PACAP antigen binding fragments thereof, as well as combinations of said antibodies or antigen binding fragments thereof, are administered to a recipient subject with a frequency of once every twenty-six weeks or less, such as once every sixteen weeks or less, once every eight weeks or less, once every four weeks or less, once every two weeks or less, once every week or less, or once daily or less.

According to preferred embodiments, the antibody containing medicament or pharmaceutical composition is peripherally administered to a subject via a route selected from one or more of: orally, sublingually, buccally, topically, rectally, via inhalation, transdermally, subcutaneously, intravenously, intra-arterially, or intramuscularly, via intracardiac administration, intraosseously, intradermally, intraperitoneally, transmucosally, vaginally, intravitreally, epicutaneously, intra-articularly, peri-articularly, or locally.

Fab fragments may be administered every two weeks or less, every week or less, once daily or less, multiple times per day, and/or every few hours. In one embodiment of the invention, a patient receives Fab fragments of 0.1 mg/kg to 40 mg/kg per day given in divided doses of 1 to 6 times a day, or in a continuous perfusion form, effective to obtain desired results.

It is to be understood that the concentration of the antibody or Fab administered to a given patient may be greater or lower than the exemplary administration concentrations set forth above.

A person of skill in the art would be able to determine an effective dosage and frequency of administration through routine experimentation, for example guided by the disclosure herein and the teachings in, *Goodman & Gilman's The Pharmacological Basis of Therapeutics*, Brunton, L. L. et al. editors, 11$^{th}$ edition, New York, N.Y.: McGraw-Hill (2006); Howland, R. D. et al., *Pharmacology, Volume 864, Lippincott's illustrated reviews.*, Philadelphia, Pa.: Lippincott Williams & Wilkins (2006); and Golan, D. E., *Principles of pharmacology: the pathophysiologic basis of drug therapy*, Philadelphia, Pa.: Lippincott Williams & Wilkins (2007).

In another embodiment of the invention, the anti-PACAP antibodies described herein, or PACAP binding fragments thereof, as well as combinations of said antibodies or antigen binding fragments thereof, are administered to a subject in a pharmaceutical formulation. In a preferred embodiment, the subject is a human.

A "pharmaceutical composition" or "medicament" refers to a chemical or biological composition suitable for administration to a subject, preferably a mammal, more preferably a human. Such compositions may be specifically formulated for administration via one or more of a number of routes, including but not limited to buccal, epicutaneous, epidural, inhalation, intraarterial, intracardial, intracerebroventricular, intradermal, intramuscular, intranasal, intraocular, intraperitoneal, intraspinal, intrathecal, intravenous, oral, parenteral, rectally via an enema or suppository, subcutaneous, subdermal, sublingual, transdermal, and transmucosal. In addition, administration can occur by means of injection, powder, liquid, gel, drops, or other means of administration.

In one embodiment of the invention, the anti-PACAP antibodies described herein, or PACAP binding fragments thereof, as well as combinations of said antibodies or antigen binding fragments thereof, may be optionally administered in combination with one or more active agents. Such active agents include analgesic, anti-histamine, antipyretic, anti-inflammatory, antibiotic, antiviral, and anti-cytokine agents. Active agents include agonists, antagonists, and modulators of TNF-α, IL-2, IL-4, IL-6, IL-10, IL-12, IL-13, IL-18, IFN-α, IFN-γ, BAFF, CXCL13, IP-10, VEGF, EPO, EGF, HRG, Hepatocyte Growth Factor ("HGF"), Hepcidin, NGF, CGRP including antibodies reactive against any of the foregoing, and antibodies reactive against any of their receptors. Active agents also include but are not limited to 2-arylpropionic acids, aceclofenac, acemetacin, acetylsalicylic acid (aspirin), alclofenac, alminoprofen, amoxiprin, ampyrone, arylalkanoic acids, azapropazone, benorylate/benorilate, benoxaprofen, bromfenac, carprofen, celecoxib, choline magnesium salicylate, clofezone, COX-2 inhibitors, dexibuprofen, dexketoprofen, diclofenac, diflunisal, droxicam, ethenzamide, etodolac, etoricoxib, faislamine, fenamic acids, fenbufen, fenoprofen, flufenamic acid, flunoxaprofen, flurbiprofen, ibuprofen, ibuproxam, indomethacin, indoprofen, kebuzone, ketoprofen, ketorolac, lornoxicam, loxoprofen, lumiracoxib, magnesium salicylate, meclofenamic acid, mefenamic acid, meloxicam, metamizole, methyl salicylate, mofebutazone, nabumetone, naproxen, N-arylanthranilic acids, NGF, oxametacin, oxaprozin, oxicams, oxyphenbutazone, oxytocin, parecoxib, phenazone, phenylbutazone, phenylbutazone, piroxicam, pirprofen, profens, proglumetacin, pyrazolidine derivatives, rofecoxib, salicyl salicylate, salicylamide, salicylates, substance P, sulfinpyrazone, sulindac, suprofen, tenoxicam, tiaprofenic acid, tolfenamic acid, tolmetin, and valdecoxib. For instance, the selected anti-PACAP antibodies, or PACAP-binding fragments thereof, as well as combinations of these antibodies or antigen binding fragments, can be optionally administered in combination with oxytocin, for instance administered in a nasal formulation, for intranasal delivery.

An anti-histamine can be any compound that opposes the action of histamine or its release from cells (e.g., mast cells). Anti-histamines include but are not limited to acrivastine, astemizole, azatadine, azelastine, betatastine, brompheniramine, buclizine, cetirizine, cetirizine analogues, chlorpheniramine, clemastine, CS 560, cyproheptadine, desloratadine, dexchlorpheniramine, ebastine, epinastine, fexofenadine, HSR 609, hydroxyzine, levocabastine, loratadine, methscopolamine, mizolastine, norastemizole, phenindamine, promethazine, pyrilamine, terfenadine, and tranilast.

Antibiotics include but are not limited to amikacin, aminoglycosides, amoxicillin, ampicillin, ansamycins, arsphenamine, azithromycin, azlocillin, aztreonam, bacitracin, carbacephem, carbapenems, carbenicillin, cefaclor, cefadroxil, cefalexin, cefalothin, cefalotin, cefamandole, cefazolin, cefdinir, cefditoren, cefepime, cefixime, cefoperazone, cefotaxime, cefoxitin, cefpodoxime, cefprozil, ceftazidime, ceftibuten, ceftizoxime, ceftobiprole, ceftriaxone, cefuroxime, cephalosporins, chloramphenicol, cilastatin, ciprofloxacin, clarithromycin, clindamycin, cloxacillin, colistin, co-trimoxazole, dalfopristin, demeclocycline, dicloxacillin, dirithromycin, doripenem, doxycycline, enoxacin, ertapenem, erythromycin, ethambutol, flucloxacillin, fosfomycin, furazolidone, fusidic acid, gatifloxacin, geldanamycin, gentamicin, glycopeptides, herbimycin, imipenem, isoniazid, kanamycin, levofloxacin, lincomycin, linezolid, lomefloxacin, loracarbef, macrolides, mafenide, meropenem, methicillin, metronidazole, mezlocillin, minocycline, monobactams, moxifloxacin, mupirocin, nafcillin, neomycin, netilmicin, nitrofurantoin, norfloxacin, ofloxacin, oxacillin, oxytetracycline, paromomycin, penicillin, penicillins, piperacillin, platensimycin, polymyxin B, polypeptides, prontosil, pyrazinamide, quinolones, quinupristin, rifampicin, rifampin, roxithromycin, spectinomycin, streptomycin, sulfacetamide, sulfamethizole, sulfanilamide, sulfasalazine, sulfisoxazole, sulfonamides, teicoplanin, telithromycin, tetracycline, tetracyclines, ticarcillin, tinidazole, tobramycin, trimethoprim, trimethoprim-sulfamethoxazole, troleandomycin, trovafloxacin, and vancomycin.

Active agents also include aldosterone, beclomethasone, betamethasone, corticosteroids, cortisol, cortisone acetate, deoxycorticosterone acetate, dexamethasone, fludrocortisone acetate, glucocorticoids, hydrocortisone, methylprednisolone, prednisolone, prednisone, steroids, and triamcinolone. Any suitable combination of these active agents is also contemplated.

A "pharmaceutical excipient" or a "pharmaceutically acceptable excipient" is a carrier, usually a liquid, in which an active therapeutic agent is formulated. In one embodiment of the invention, the active therapeutic agent is a humanized antibody described herein, or one or more fragments thereof. The excipient generally does not provide any pharmacological activity to the formulation, though it may provide chemical and/or biological stability, and release characteristics. Exemplary formulations can be found, for example, in *Remington's Pharmaceutical Sciences*, Gennaro, A. editor, 19$^{th}$ edition, Philadelphia, Pa.: Williams and Wilkins (1995), which is incorporated by reference.

As used herein "pharmaceutically acceptable carrier" or "excipient" includes any and all solvents, dispersion media, coatings, antibacterial and antifungal agents, isotonic, and absorption delaying agents that are physiologically compatible. In one embodiment, the carrier is suitable for parenteral administration. Alternatively, the carrier can be suitable for intravenous, intraperitoneal, intramuscular, or sublingual administration. Pharmaceutically acceptable carriers include sterile aqueous solutions or dispersions and sterile powders for the extemporaneous preparation of sterile injectable solutions or dispersions. The use of such media and agents for pharmaceutically active substances is well known in the art. Except insofar as any conventional media or agent is incompatible with the active compound, use thereof in the pharmaceutical compositions of the invention is contemplated. Supplementary active compounds can also be incorporated into the compositions.

Pharmaceutical compositions typically must be sterile and stable under the conditions of manufacture and storage. The invention contemplates that the pharmaceutical composition is present in lyophilized form. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol), and suitable mixtures thereof. The invention further contemplates the inclusion of a stabilizer in the pharmaceutical composition. The proper fluidity can be maintained, for example, by the maintenance of the required particle size in the case of dispersion and by the use of surfactants.

In many cases, it will be preferable to include isotonic agents, for example, sugars, polyalcohols such as mannitol and sorbitol, or sodium chloride in the composition. Absorption of the injectable compositions can be prolonged by including an agent that delays absorption, for example, monostearate salts and gelatin. Moreover, the alkaline polypeptide can be formulated in a time-release formulation, for example in a composition that includes a slow release polymer. The active compounds can be prepared with carriers that will protect the compound against rapid release, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, polylactic acid, polylactic and polyglycolic copolymers ("PLG"). Many methods for the preparation of such formulations are known to those skilled in the art.

For each of the recited embodiments, the compounds can be administered by a variety of dosage forms. Any biologically acceptable dosage form known to persons of ordinary skill in the art, and combinations thereof, are contemplated. Examples of such dosage forms include, without limitation, reconstitutable powders, elixirs, liquids, solutions, suspensions, emulsions, powders, granules, particles, microparticles, dispersible granules, cachets, inhalants, aerosol inhalants, patches, particle inhalants, implants, depot implants, injectables (including subcutaneous, intramuscular, intravenous, and intradermal), infusions, and combinations thereof.

The above description of various illustrated embodiments of the invention is not intended to be exhaustive or to limit the invention to the precise form disclosed. While specific embodiments of, and examples for, the invention are described herein for illustrative purposes, various equivalent modifications are possible within the scope of the invention, as those skilled in the relevant art will recognize. The teachings provided herein of the invention can be applied to other purposes, other than the examples described above.

These and other changes can be made to the invention in light of the above detailed description. In general, in the following claims, the terms used should not be construed to limit the invention to the specific embodiments disclosed in the specification and the claims. Accordingly, the invention is not limited by the disclosure, but instead the scope of the invention is to be determined entirely by the following claims.

The invention may be practiced in ways other than those particularly described in the foregoing description and examples. Numerous modifications and variations of the invention are possible in light of the above teachings and, therefore, are within the scope of the appended claims.

Certain teachings related to methods for obtaining a clonal population of antigen-specific B-cells were disclosed in U.S. Patent Publication No. US2013/0316353, the disclosure of which is herein incorporated by reference in its entirety.

Certain teachings related to humanization of rabbit-derived monoclonal antibodies and preferred sequence modifications to maintain antigen-binding affinity were disclosed in International Publication No. WO 2008/144757, entitled *Novel Rabbit Antibody Humanization Methods and Humanized Rabbit Antibodies*, filed May 21, 2008, the disclosure of which is herein incorporated by reference in its entirety.

Certain teachings related to producing antibodies or fragments thereof using mating competent yeast and corresponding methods were disclosed in U.S. Patent Publication No. US2006/0270045, the disclosure of which is herein incorporated by reference in its entirety.

Certain teachings related to producing antibodies or fragments thereof in *Pichia* and preferred methods for obtaining and purifying antibodies are also disclosed in published, commonly assigned U.S. Patent Publication Nos. US20140288272; US20140287952; US20130055888; and US20120277408, the disclosures of each of which are herein incorporated by reference in their entirety.

Certain teachings related to producing antibodies or fragments thereof in CHO cells and preferred methods for obtaining and purifying antibodies are also disclosed in published, commonly assigned U.S. Patent Publication Nos. U.S. Pat. No. 7,932,087B2; US20090285795A1; U.S. Pat. No. 9,090,672 B2; and US20100221781 A1; the disclosures of each of which are herein incorporated by reference in their entirety.

Certain anti-PACAP antibody polynucleotides and polypeptides are disclosed in the sequence listing accompanying this patent application filing, and the disclosure of said sequence listing is herein incorporated by reference in its entirety.

The entire disclosure of each document cited (including patents, patent applications, journal articles, abstracts, manuals, books, or other disclosures) in the Background of the Invention, Detailed Description, and Examples is herein incorporated by reference in their entireties.

The following examples are put forth so as to provide those of ordinary skill in the art with a complete disclosure and description of how to make and use the subject invention, and are not intended to limit the scope of what is regarded as the invention. Efforts have been made to ensure accuracy with respect to the numbers used (e.g. amounts, temperature, concentrations, etc.), but some experimental errors and deviations should be allowed for. Unless otherwise indicated, parts are parts by weight, molecular weight is average molecular weight, temperature is in degrees centigrade; and pressure is at or near atmospheric.

EXAMPLES

Example 1

Preparation of Antibodies that Selectively Bind PACAP

By using an antibody selection protocol substantially as described herein, a panel of antibodies specific to PACAP38 and PACAP27, and a panel of antibodies specific to PACAP38 only, were produced.

Immunization Strategy

Rabbits were immunized with PACAP38 (American Peptide, Vista, Calif.) (SEQ ID NO: 1241). Peptides were prepared for immunization as follows. A 0.15 ml volume of 10 mg/ml keyhole limpet hemocyanin ("KLH") dissolved in Dulbecco's phosphate buffered saline ("DPBS") supplemented to 1M NaCl was combined with 1.0 ml of 1 mg/ml peptide (dissolved in deionized water). Then 1.0 ml of 40 mM carbodiimide was added prior to a 12-hour incubation at room temperature with gentle mixing. Excess carbodiimide and unconjugated peptide were removed by dialysis to DPBS prior to sterile filtration. Next unconjugated peptide equal to the initial mass of KLH was added prior to preparation for injection into rabbits. Alternatively, equal masses of sterile KLH and peptide were mixed without carbodiimide chemistry.

Immunizations were performed by diluting 200 µg of antigen to 0.5 ml with DPBS and mixing with an equal volume of complete Freund's adjuvant for subcutaneous 1 ml injection at Day 1.

Boost injections of 100 µg were performed with incomplete Freund's adjuvant at Days 21 and 42.

Antibody Selection Functional Titer Assessment

To identify antibodies that neutralize PACAP38 (SEQ ID NO: 1241) induced signaling via PAC1-R, polyclonal antibody solutions were first purified via Protein A and dialyzed into a neutral buffer. Briefly, antibody solutions were incubated with PACAP38 (SEQ ID NO: 1241) at 4× the final concentration (100 pM) for 1 hr. While the antibody/antigen complexes were incubated, PAC1-R expressing PC-12 cells (Japanese Collection of Research Bioresources Cell Bank) were washed and re-suspended at $2 \times 10^6$ cells per ml in cell culture media. Cells (10 µl) and antigen/antibody complex (40 µl) were transferred to a homogenous time resolved fluorescence ("HTRF") plate and shaken at room temperature for 30 min. Following the incubation, 20 µl of (1:20 diluted) $Eu^{3+}$ cryptate-labeled mAb anti-cAMP and 20 µl of (1:20 diluted) d2-labeled cAMP in lysis buffer were added, and the plate was incubated for 1 hr while shaking. Following incubation, plates were read (excitation 330 nm, emission 620/665 nm), and a ratio of 620:665 signal was determined.

Tissue Harvesting

Once acceptable titers were established, the rabbit(s) were sacrificed. Spleen, lymph nodes, and whole blood were harvested and processed as follows:

Spleen and lymph nodes were processed into a single cell suspension by disassociating the tissue and pushing through sterile wire mesh at 70 µm (Thermo Fisher Scientific, Waltham, Mass.) with a plunger of a 20 cc syringe. Cells were collected in phosphate buffered saline ("PBS"). Cells were then washed twice by centrifugation. After the last wash, cell density was determined by trypan blue. Cells were centrifuged at 1500 RPM for 10 minutes; the supernatant was then discarded. Cells were resuspended in the appropriate volume of 10% dimethyl sulfoxide ("DMSO", Sigma-Aldrich Co., St. Louis, Mo.) in fetal bovine serum ("FBS" HYCLONE™, GE Healthcare Life Sciences, Marlborough, Mass.) and dispensed at 1 ml/vial. Vials were stored at −70° C. in a slow freezing chamber for 24 hours and stored in liquid nitrogen.

Peripheral blood mononuclear cells ("PBMCs") were isolated by mixing whole blood with equal parts of PBS. 35 ml of the whole blood mixture was carefully layered onto 8 ml of LYMPHOLYTE® Rabbit (Cedarlane Laboratories, Burlington, Ontario) into a 45 ml conical tube (Corning, Corning, N.Y.) and centrifuged for 30 minutes at 2500 RPM at room temperature without brakes. After centrifugation, the PBMC layers were carefully removed using a glass Pasteur pipette (VWR International, Radnor, Pa.), combined, and placed into a clean 50 ml vial. Cells were washed twice with PBS by centrifugation at 1500 RPM for 10 minutes at room temperature, and cell density was determined by trypan blue staining. After the last wash, cells were resuspended in an appropriate volume of 10% DMSO/FBS medium and frozen as described above.

B-cell Selection, Enrichment, and Culture Conditions

On the day of setting up B-cell culture, PBMC, splenocyte, or lymph node vials were thawed for use. Vials were removed from liquid nitrogen tank and placed in a 37° C. water bath until thawed. Contents of vials were transferred into 15 ml conical centrifuge tube (Corning, Inc., Corning, N.Y.) and 10 ml of modified RPMI was slowly added to the tube. Cells were centrifuged for 5 minutes at 2000 RPM, and the supernatant was discarded. Cells were resuspended in 10 ml of fresh media. Cell density and viability was determined by trypan blue.

For positive selection of anti-PACAP38 producing B-cells, biotinylated PACAP38 (SEQ ID NO: 1241) was pre-loaded onto the streptavidin beads as follows. 75 µl of streptavidin beads (Miltenyi Biotec, Auburn, Calif.) were mixed with N-terminally biotinylated PACAP38 (10 µg/ml final concentration) and 300 µl of PBS supplemented with 0.5% biotin free bovine serum albumin ("BSA") and 2 mM EDTA ("PBF"). This mixture was incubated at 4° C. for 30 minutes, and unbound biotinylated PACAP38 (AnaSpec, Fremont, Calif.) was removed using a MACS® separation column (Miltenyi Biotec, Auburn, Calif.) with a 1 ml rinse to remove unbound material. The bound material was plunged out by detachment from the magnet and used to resuspend cells from above in 100 μl per $1\times10^7$ cells. The mixture was then incubated at 4° C. for 30 minutes and washed once with 10 ml of PBF. After washing, the cells were resuspended in 500 μl of PBF and set aside. A MACS® MS column (Miltenyi Biotec, Auburn, Calif.) was pre-rinsed with 500 μl of PBF on a magnetic stand (Miltenyi Biotec, Auburn, Calif.). Cell suspension was applied to the column through a pre-filter, and unbound fraction was collected. The column was washed with 2.5 ml of PBF buffer. The column was removed from the magnet stand and placed onto a clean, sterile 1.5 ml EPPENDORF™ tube. 1 ml of PBF buffer was added to the top of the column, and positive selected cells were collected. The yield and viability of positive cell fraction was determined by trypan blue staining. Positive selection yielded an average of 1% of the starting cell concentration.

A pilot cell screen was established to provide information on seeding levels for the culture. Plates were seeded at 5, 10, 25, 50, 100, or 200 enriched B-cells/well. In addition, each well contained 25-50K cells/well of irradiated EL-4.B5 cells (5,000 Rads) and an appropriate level of activated rabbit T-cell supernatant (See U.S. Patent Application Publication No. 20070269868) (ranging from 1-5% depending on preparation) in high glucose modified RPMI medium at a final volume of 250 μl/well. Cultures were incubated for 5 to 7 days at 37° C. in 4% $CO_2$.

B-Cell Culture Screening by Antigen-Recognition (ELISA)

To identify wells producing anti-PACAP38 antibodies, B-cell supernatants were tested by antigen-recognition (ELISA). Briefly, NEUTRAVIDIN™-coated plates (Thermo Fisher Scientific, Waltham, Mass.), were coated with either N-term or C-term biotinylated PACAP38 (AnaSpec Inc., Fremont, Calif.) (50 μl per well; 1 μg/ml) diluted in ELISA buffer (0.5% fish skin gelatin in PBS pH 7.4) either for approximately 1 hour at room temperature or alternatively overnight at 4° C. The plates were then further blocked with ELISA buffer for one hour at room temperature and washed using PBS with 0.05% Tween 20 ("wash buffer"). B-cell supernatant samples (50 μl) were transferred onto the wells and incubated for one hour at room temperature. After this incubation, the plate was washed with wash buffer. For development, an anti-rabbit specific Fc-Horse Radish Peroxidase ("Fc-HRP") (1:5000 dilution in ELISA buffer) was added onto the wells and incubated for 45 minutes at room temperature. After a 3× wash step with wash solution, the plate was developed using 3,3',5,5'-Tetramethylbenzidine ("TMB") substrate for two minutes at room temperature, and the reaction was quenched using 0.5M HCl. The well absorbance was read at 450 nm.

To identify wells producing anti-PACAP38 antibodies that do not recognize VIP (SEQ ID NO: 1243), supernatant from wells positive for PACAP38 binding by ELISA were tested by ELISA for binding to VIP. Briefly, biotinylated VIP (AnaSpec Inc., Fremont, Calif.) was bound onto NEUTRAVIDIN™ coated plates (50 μg per well, 1 μg/μl each peptide). B-cell supernatant samples (50 μl) were tested without prior dilution. Recognition in this assay may indicate cross reactivity with a closely related peptide, VIP.

Identification of Functional Activity in B-cell Supernatants Using One or More Assays To identify wells producing anti-PACAP38 antibodies that block signaling of PACAP38 via PAC1-R, supernatant from positive wells for PACAP38 binding by ELISA were tested in a cAMP HTRF assay (Cisbio US, Bedford, Mass.). Supernatants (78 μl) were pre-incubated with 2 μl 5 nM PACAP38 (American Peptide Company, Sunnyvale, Calif.) for 1 hour at 37° C. During the incubation, PC-12 cells were prepared as described for titer assessment. Cells (10 μl) and antigen/antibody complex (40 μl) were transferred to an HTRF plate and shaken at room temperature for 30 minutes. Following the incubation, 20 μl of (1:20 diluted) $Eu^{3+}$ cryptate-labeled mAb anti-cAMP and 20 μl of (1:20 diluted) d2-labeled cAMP in lysis buffer were added, and the plate was incubated for 1 hour while shaking. Following incubation plates were read (excitation 330 nm, emission 620/665 nm), and a ratio of 620:665 signal was determined.

Isolation of Antigen-Specific B-cells

Antigen-specific B-cells were isolated (for general methods see co-owned publication no. WO 2014/146074, which is hereby incorporated by reference in its entirety). Plates containing wells of interest were removed from −70° C., and the cells from each well were recovered using five washes of 200 μl of medium (10% RPMI complete, 55 μM β-mercaptoethanol ("BME")) per well. The recovered cells were pelleted by centrifugation and the supernatant was carefully removed. Cells from each well were then re-suspended in 100 μl of medium and transferred to a 96 well plate. Cells were incubated for 90 minutes at 37° C. Following incubation, cells were pelleted by centrifugation, stained with a fluorescein isothiocyanate-labeled ("FITC-labeled") anti-rabbit IgG (final concentration 6.25 μg/ml) (Creative Diagnostics, Shirley, N.Y.), and washed with up to 2 ml fluorescence-activated cell sorting buffer ("FACS buffer") (Dulbecco's PBS w/2% FBS) and re-suspended in 250 μl of FACS buffer.

Control wells from the same culture sets that were similar in composition to pooled wells of interest were thawed and stained alongside target wells. These samples were initially run on FACS (BD INFLUX™, Becton, Dickinson and Company, Franklin Lakes, N.J.), and gates were established for IgG, viability, and physical parameters (Forward scatter ("FSC")/side scatter ("SSC")) that differentiate B-cells from the murine EL4 cells. Once gates were established, the sample of interest was run, and IgG positive, viable cells that were of a consistent physical (FSC/SSC) population were sorted individually into wells of a 96 well plate pre-loaded with RT-PCR master mix. Upwards of 8 cells per well were sorted. Sorted plates were removed from the sorter and transferred directly to thermocyclers for PCR.

Amplification and Sequence Determination of Antibody Sequences from FACS-Sorted B-Cells Antibody sequences were recovered using a combined RT-PCR based method from a single cell sorted B-cell. Primers containing restriction enzymes were designed to anneal in conserved and constant regions of the target immunoglobulin genes (heavy and light), such as rabbit immunoglobulin sequences, and a two-step nested PCR recovery was used to amplify the antibody sequence. Amplicons from each well were sequenced and analyzed. Representative antibodies from the resulting sequence clusters were selected for recombinant protein expression. The original heavy and light variable regions amplified from rabbit cells were cloned into human heavy and light chain constant region expression vectors via restriction enzyme digestion and ligation, and via Gibson method. Vectors containing subcloned DNA fragments were amplified and purified. The sequences of the subcloned heavy and light chains were verified prior to expression.

Recombinant Production of Monoclonal Antibody of Desired Antigen Specificity and/or Functional Properties To determine antigen specificity and functional properties of recovered antibodies from specific B-cells, the heavy and light chain plasmids were co-transfected to generate rabbit/human chimeric antibodies for testing. Briefly, heavy and light chimeric plasmids were transiently transfected into HEK-293 cells. Transfections were allowed to incubate for 5-7 days, and upon harvest, cells were pelleted by centrifugation. Supernatants were submitted for purification via Protein A. Resulting purified chimeric antibodies were then evaluated in a variety of assays to confirm specificity and potency.

Using the above-described methods, numerous functional (antagonistic) antibodies that bind PACAP38 and PACAP27, or that bind PACAP38 only, but which do not, or do not appreciably, bind to VIP were identified. Polypeptide and exemplary coding sequences of exemplary antagonistic anti-PACAP antibodies are contained in the included biological sequence listing.

The full-length antibodies Ab1, Ab1.H, Ab2, Ab13, Ab14, Ab15, Ab16, Ab17, Ab18, Ab19, Ab5, Ab7, Ab11, Ab12, Ab4, Ab3, Ab6, Ab8, Ab9, Ab22, Ab23, Ab3.H, Ab4.H, Ab5.H, Ab9.H, and Ab12.H used in these examples were expressed as the heavy chain polypeptides having the sequences of SEQ ID NO: 1; 41; 81; 121; 161; 201; 241; 281; 321; 361; 481; 521; 561; 601; 641; 681; 721; 761; 801; 881; 921; 1121; 1081; 1001; 1161; and 1041, respectively, and the light chain polypeptides of SEQ ID NO: 21; 61; 101; 141; 181; 221; 261; 301; 341; 381; 501; 541; 581; 621; 661; 701; 741; 781; 821; 901; 941; 1141; 1101; 1021; 1181; and 1061, respectively. The heavy chain polypeptides of antibodies Ab1, Ab1.H, Ab2, Ab13, Ab14, Ab15, Ab16, Ab17, Ab18, Ab19, Ab5, Ab7, Ab11, Ab12, Ab4, Ab3, Ab6, Ab8, Ab9, Ab22, Ab23, Ab3.H, Ab4.H, Ab5.H, Ab9.H, and Ab12.H were expressed from the polynucleotides of SEQ ID NO: 11; 51; 91; 131; 171; 211; 251; 291; 331; 371; 491; 531; 571; 611; 651; 691; 731; 771; 811; 891; 931; 1131; 1091; 1011; 1171; and 1051, respectively. The light chain polypeptides of antibodies Ab1, Ab1.H, Ab2, Ab13, Ab14, Ab15, Ab16, Ab17, Ab18, Ab19, Ab5, Ab7, Ab11, Ab12, Ab4, Ab3, Ab6, Ab8, Ab9, Ab22, Ab23, Ab3.H, Ab4.H, Ab5.H, Ab9.H, and Ab12.H were expressed from the polynucleotides of SEQ ID NO: 31; 71; 111; 151; 191; 231; 271; 311; 351 391; 511; 551; 591; 631; 671; 711; 751; 791; 831; 911; 951; 1151; 1111; 1031; 1191; and 1071, respectively. Additional features of said antibodies are identified by SEQ ID NOS in FIGS. 1A-12.

Antigen Binding Specificity of Antibodies by Competitive HTRF Binding Assay

The binding and functional properties of exemplary anti-PACAP38 and anti-PACAP27 antibodies produced according to the invention are further described below.

To identify antibodies that preferentially bind PACAP38 (SEQ ID NO: 1241) and PACAP27 (SEQ ID NO: 1242), but do not bind VIP (SEQ ID NO: 1243), or to identify antibodies that specifically bind PACAP38, but do not bind appreciably PACAP27, or do not appreciably bind VIP, etc., a competition HTRF binding assay was performed.

In parallel, 10 µl of an antibody dilution series (highest final concentration of 100 nM) were incubated with 10 µl of N-terminal or C-terminal biotinylated PACAP38 (35 nM final) alone, or in combination with either PACAP27 (350 nM final) or VIP (350 nM final), i.e., 10×PACAP27 or 10×VIP, respectively, in a HTRF plate. 20 µl of $Eu^{3+}$ cryptate labeled anti-hu Fc donor and 20 µl of d2-labeled streptavidin acceptor were added to each well and incubated for 1 hour at room temperature. Fluorescence was measured at 620 and 665 nm with a delay of 300 µsec.

Figure 13A:
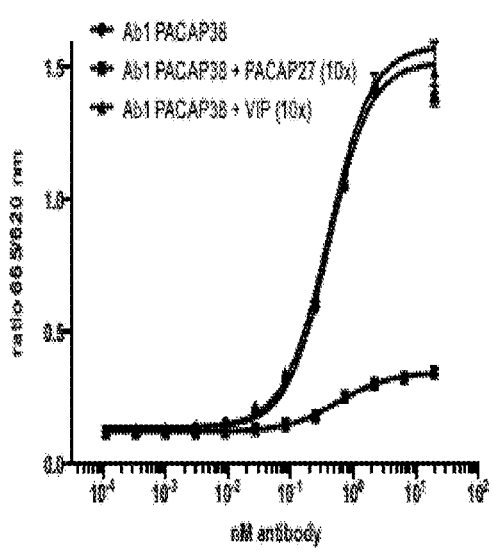
FIG. 13A-13V provides representative competitive binding data for Ab1 (FIG. 13A), Ab2 (FIG. 13B), Ab3 (FIG. 13C), Ab4 (FIG. 13D), Ab5 (FIG. 13E), Ab6 (FIG. 13F), Ab7 (FIG. 13G), Ab8 (FIG. 13H), Ab9 (FIG. 13I), Ab10 (FIG. 13J), Ab11 (FIG. 13K), Ab12 (FIG. 13L), Ab13 (FIG. 13M), Ab14 (FIG. 13N), Ab15 (FIG. 13O), Ab16 (FIG. 13P), Ab17 (FIG. 13Q), Ab18 (FIG. 13R), Ab19 (FIG. 13S), Ab1.H, (FIG. 13T), Ab22 (FIG. 13U), and Ab23 (FIG. 13V), respectively, obtained following the protocol in Example 1 infra.
Figure 13B:
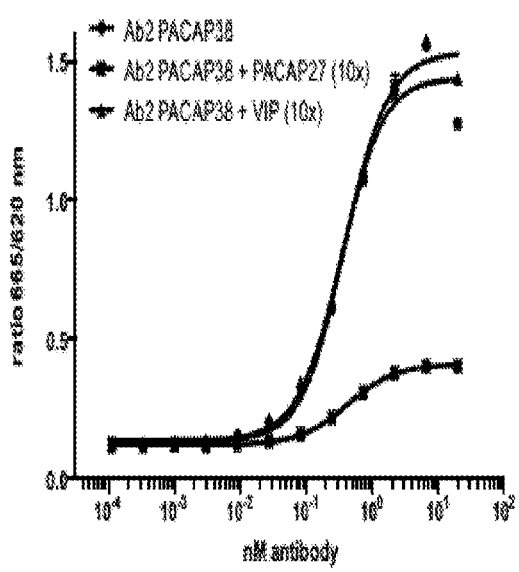
Figure 13C:
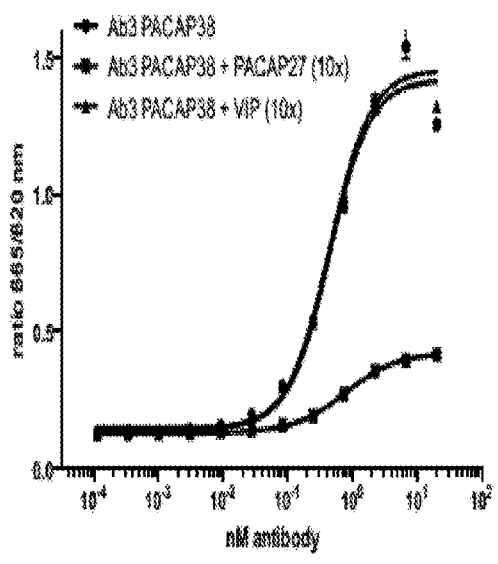
Figure 13D:
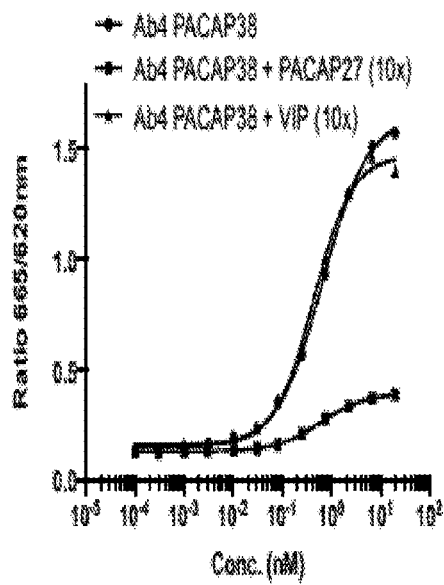
Figure 13E:
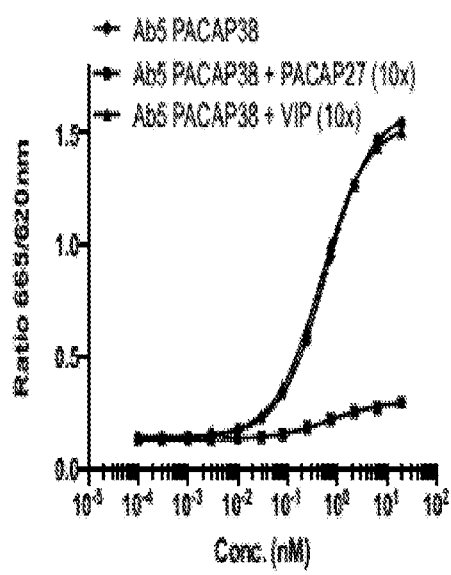
Figure 13F:
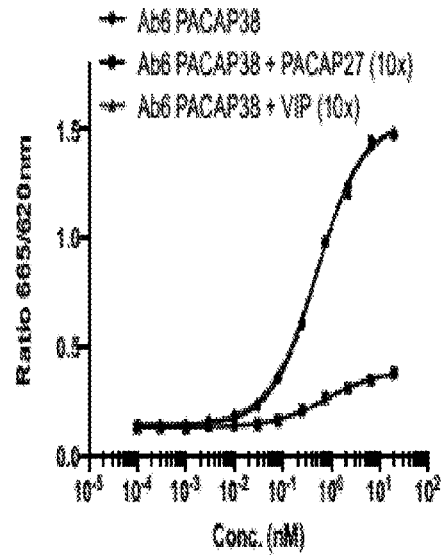
Figure 13G:
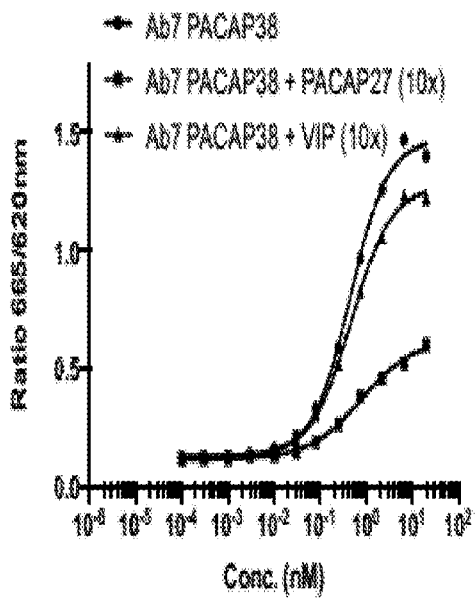
Figure 13H:
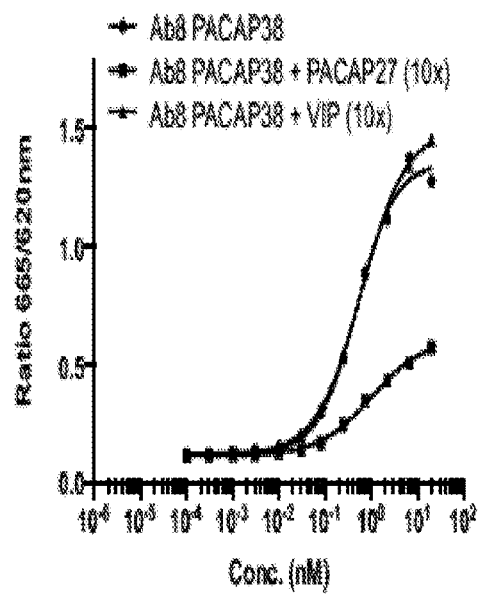
Figure 13I:
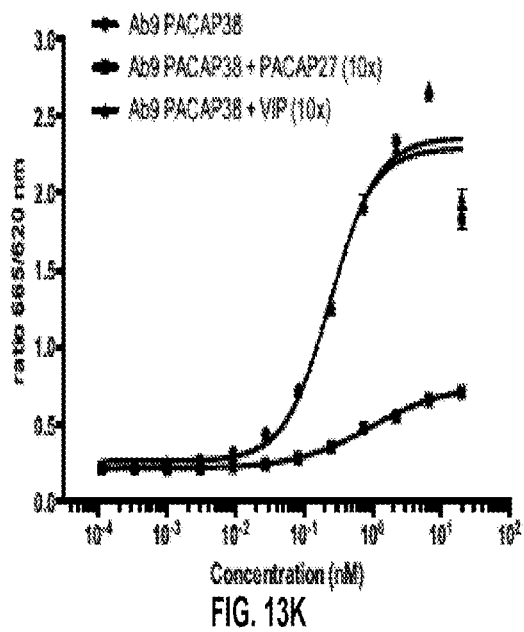
Figure 13J:
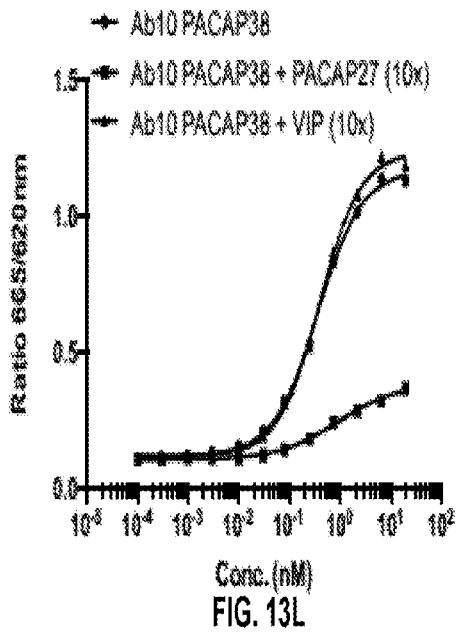
Figure 13K:
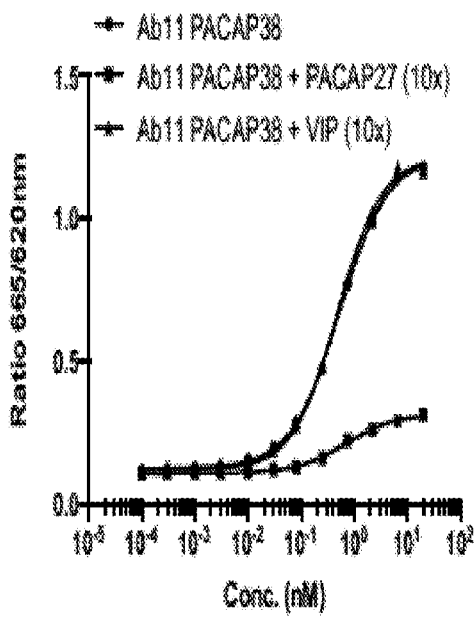
Figure 13L:
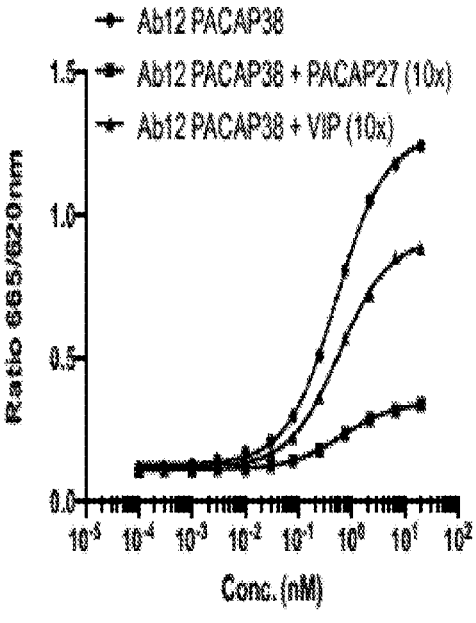
Figure 13M:
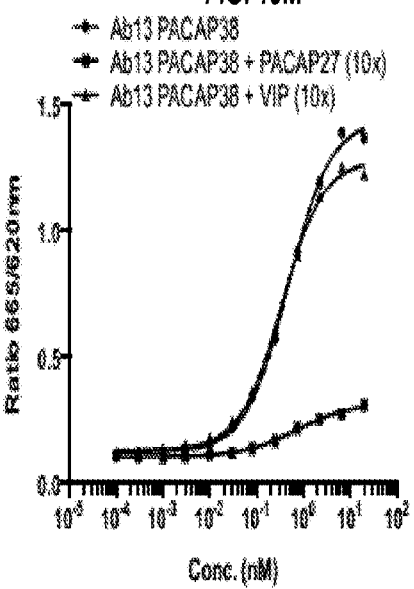
Figure 13N:
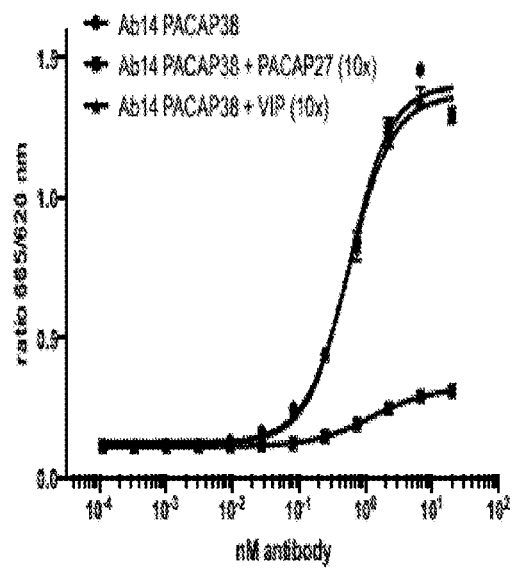
Figure 13O:
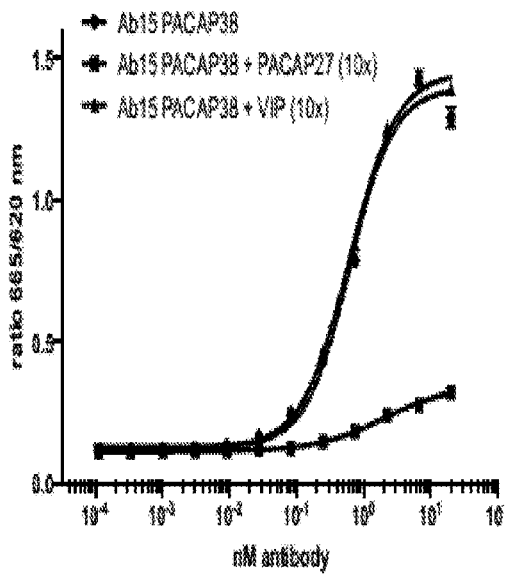
Figure 13P:
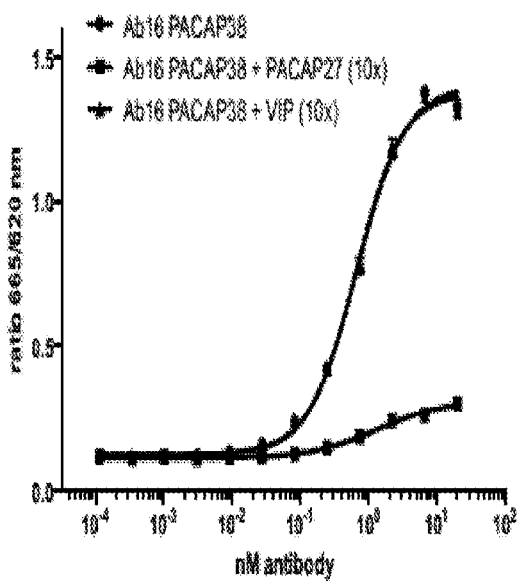
Figure 13U:
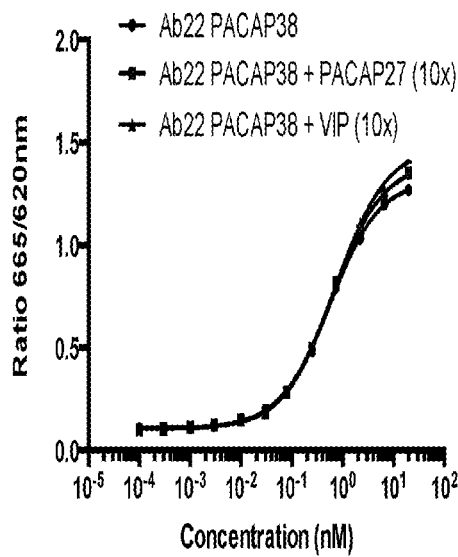
Figure 13V:
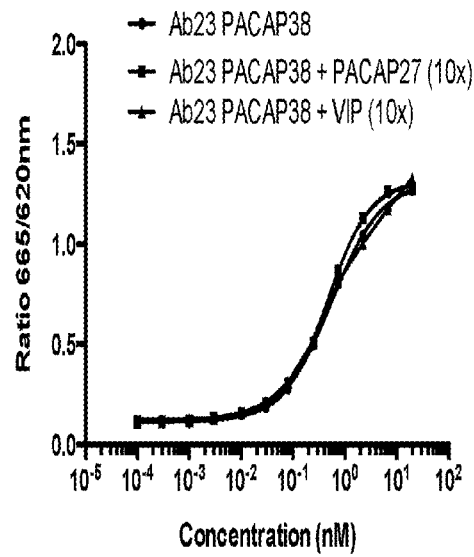

FIGS. 13A-13T provide representative binding data for Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, and Ab1.H to PACAP38 and to PACAP27, and the inability of VIP to compete with binding of PACAP38. FIG. 13U and FIG. 13V provide representative binding data for the anti-PACAP antibodies Ab22 and Ab23 to PACAP38 and the inability of PACAP27 or VIP to compete with binding of PACAP38. The lack of effect of VIP on binding to PACAP38 indicated its inability to compete with binding of PACAP38. These results demonstrated that Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, and Ab1.H bind to PACAP38 and PACAP27, but do not bind (or do not appreciably bind) VIP. These results also demonstrated that Ab22 and Ab23 bind to PACAP38, but do not bind (or do not appreciably bind) PACAP27 or VIP.

$EC_{50}$ values, i.e. the concentration of an antibody that yields a response halfway between the baseline and the maximum value within a specified time period, were computed for each antibody based upon their binding curves and are shown in Table 1 below. The results demonstrated that Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab22, Ab23, and Ab1.H bound to and recognized human PACAP38 with high affinity. A humanized form of antibody Ab1 was produced and is identified by an appended ".H", i.e., Ab1.H, and it also bound PACAP38 with high affinity.

TABLE 1

Binding ($EC_{50}$) of PACAP38 by anti-PACAP antibodies

| ANTIBODY | PACAP38-binding $EC_{50}$ (nM) |
|---|---|
| Ab1 | 0.43 |
| Ab2 | 0.35 |
| Ab3 | 0.45 |
| Ab4 | 0.66 |
| Ab5 | 0.60 |
| Ab6 | 0.50 |
| Ab7 | 0.45 |
| Ab8 | 0.48 |
| Ab9 | 0.23 |
| Ab10 | 0.36 |
| Ab11 | 0.53 |
| Ab12 | 0.51 |
| Ab13 | 0.48 |
| Ab14 | 0.57 |
| Ab15 | 0.62 |
| Ab16 | 0.68 |
| Ab17 | 0.46 |
| Ab18 | 0.48 |
| Ab19 | 0.43 |
| Ab1.H | 0.46 |
| Ab22 | 0.57 |
| Ab23 | 0.56 |

Ability of Anti-PACAP Antibodies to Neutralize PACAP38-Induced and PACAP27-Induced cAMP Production The ability of anti-PACAP antibodies to neutralize PACAP38-induced and PACAP27-induced PAC1-R signaling was tested in a cell-based assay.

For Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab22, Ab23, Ab1.H, Ab10.H, Ab3.H, Ab4.H, Ab5.H, Ab9.H and Ab12.H, to identify antibodies that neutralized PACAP38-induced and PACAP27-induced signaling via PAC1-R, antibody solutions were incubated with either PACAP38 or with PACAP27 at 4× the final concentration (100 pM) for 1 hour. While the antibody/antigen complexes were incubated, PAC1-R expressing PC-12 cells (Japanese Collection of Research Bioresources Cell Bank) were washed and re-suspended at $2\times10^6$ cells per ml in cell culture media. Cells (10 µl) and antigen/antibody complex (40 µl) were transferred to an HTRF plate and shaken at room temperature for 30 minutes. Following the incubation, 20 µl of (1:20 diluted) $Eu^{3+}$ cryptate-labeled mAb anti-cAMP and 20 µl of (1:20 diluted) d2-labeled cAMP in lysis buffer were added, and the plate was incubated for 1 hour while shaking. Following incubation, plates were read (excitation 330 nm, emission 620/665 nm), and a ratio of 620:665 signal was determined. The final concentration of PACAP38 and PACAP27 in each well was 0.1 nM.

Figure 16E:
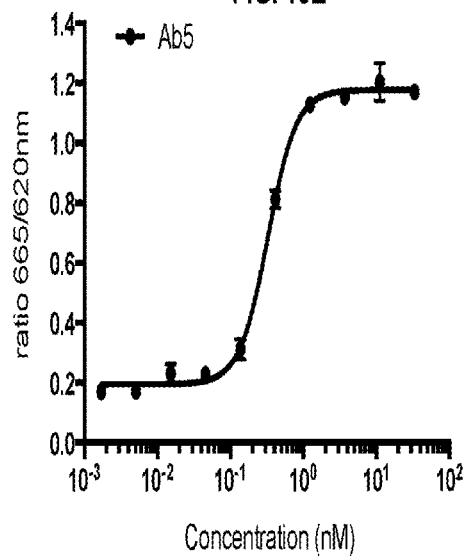
FIGS. 16A-16BB provides representative data showing Ab1-mediated (FIG. 16A), Ab2-mediated (FIG. 16B), Ab3-mediated (FIG. 16C), Ab4-mediated (FIG. 16D), Ab5-mediated (FIG. 16E), Ab6-mediated (FIG. 16F), Ab7-mediated (FIG. 16G), Ab8-mediated (FIG. 16H), Ab9-mediated (FIG. 16I), Ab10-mediated (FIG. 16J), Ab11-mediated (FIG. 16K), Ab12-mediated (FIG. 16L), Ab13-mediated (FIG. 16M), Ab14-mediated (FIG. 16N), Ab15-mediated (FIG. 16O), Ab16-mediated (FIG. 16P), Ab17-mediated (FIG. 16Q), Ab18-mediated (FIG. 16R), Ab19-mediated (FIG. 16S), Ab1.H-mediated (FIG. 16T), Ab10.H-mediated (FIG. 16U), Ab22-mediated (FIG. 16V), Ab23-mediated (FIG. 16W), Ab3.H-mediated (FIG. 16X), Ab4.H-mediated (FIG. 16Y), Ab5.H-mediated (FIG. 16Z), Ab9.H-mediated (FIG. 16AA), and Ab12.H-mediated (FIG. 16BB) inhibition of PACAP38-driven cAMP production via PAC1-R-expressing PC-12 cells obtained following the protocol in Example 1 infra.
Figure 16F:
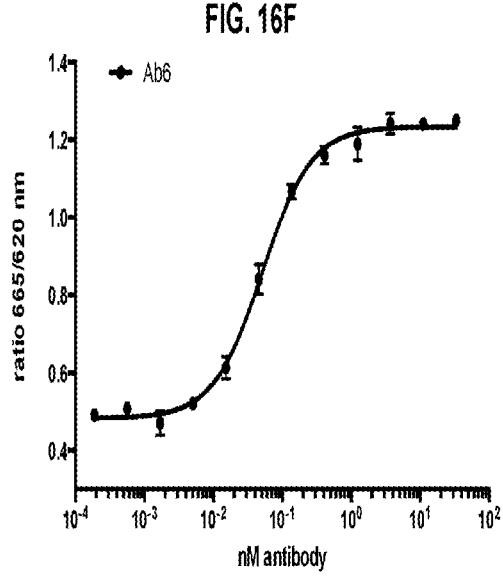
Figure 16G:
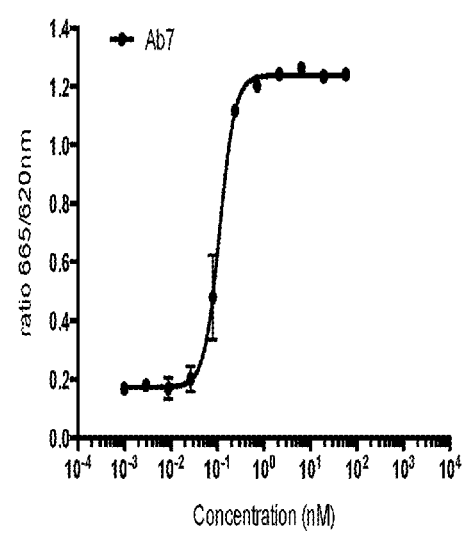
Figure 16H:
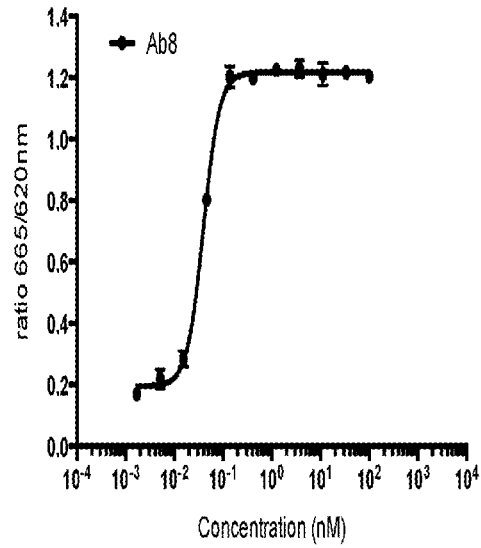
Figure 16I:
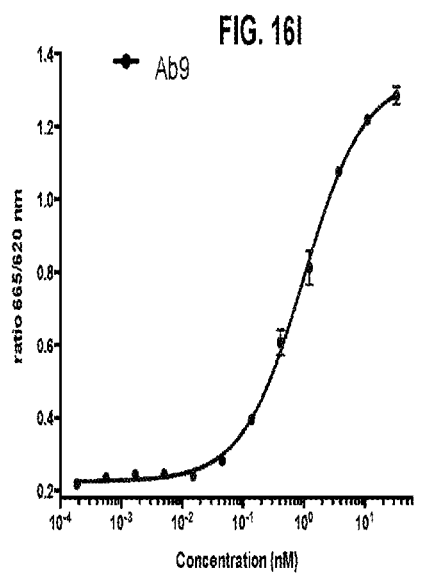
Figure 16J:
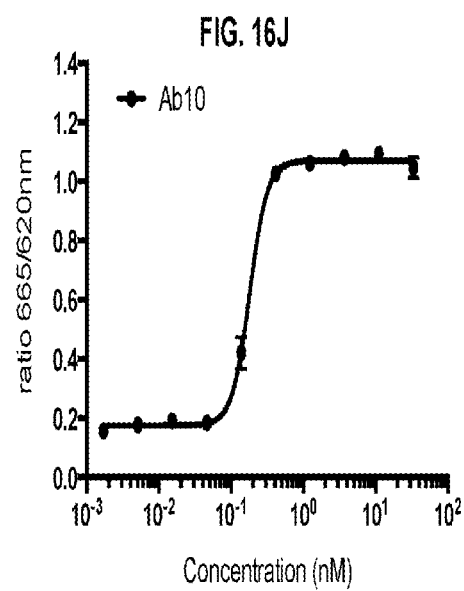
Figure 16K:
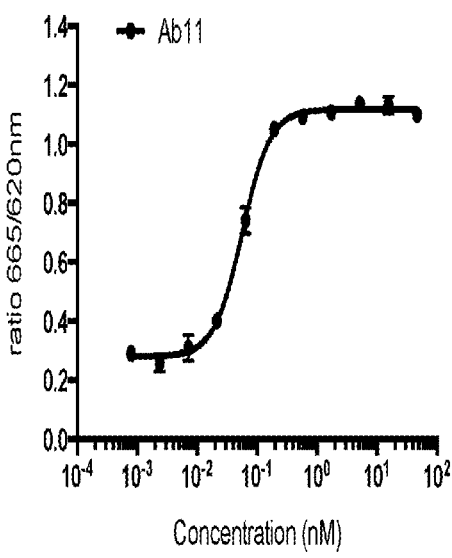
Figure 16L:
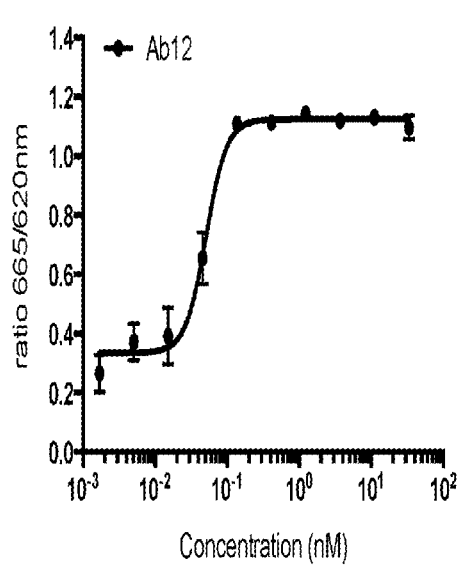
Figure 16M:
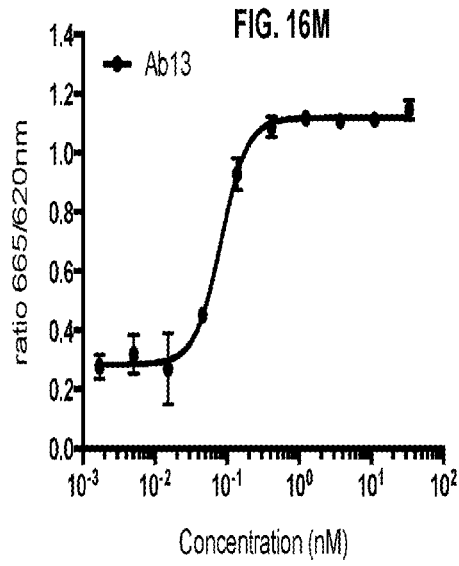
Figure 16N:
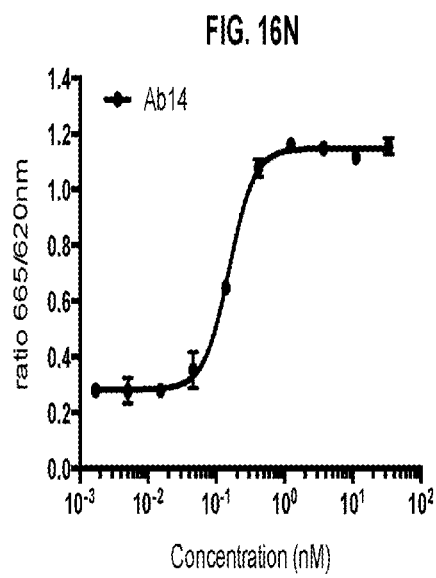
Figure 16O:
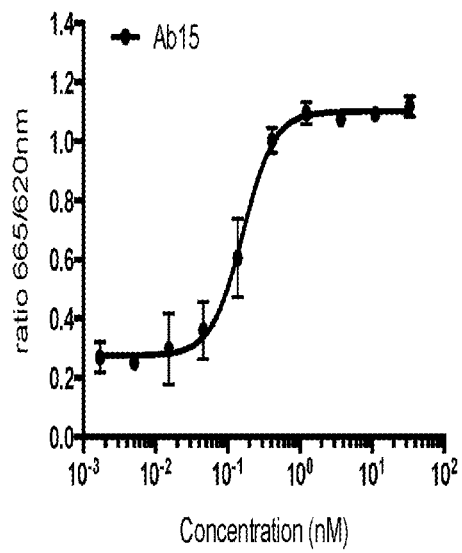
Figure 16P:
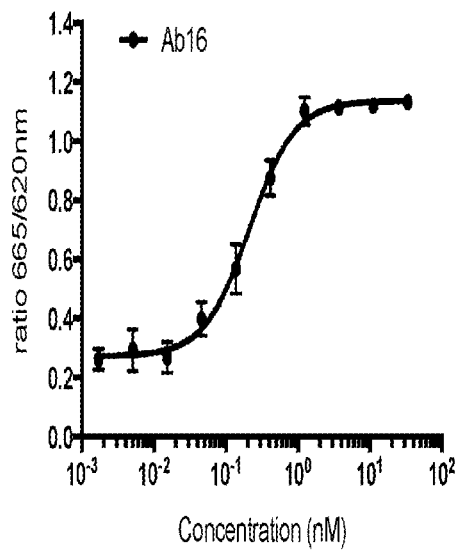
Figure 16Q:
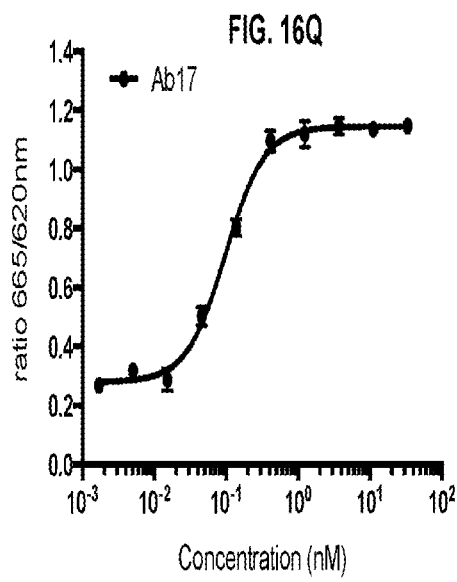
Figure 16R:
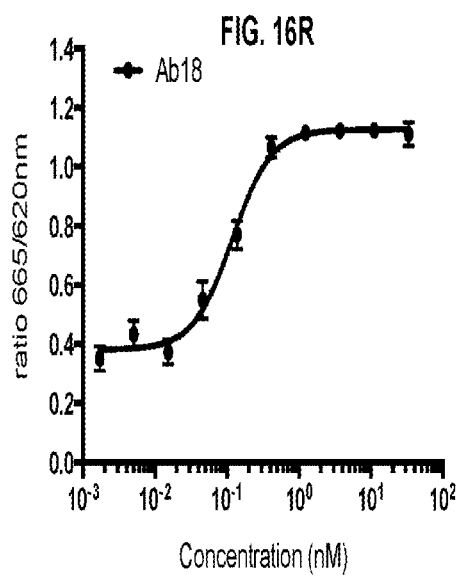
Figure 16S:
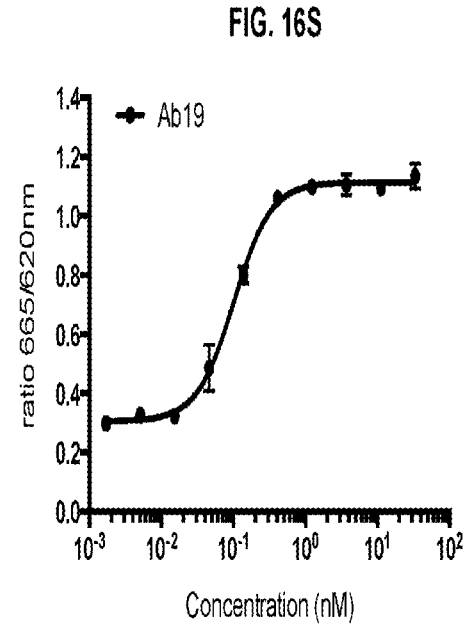
Figure 16T:
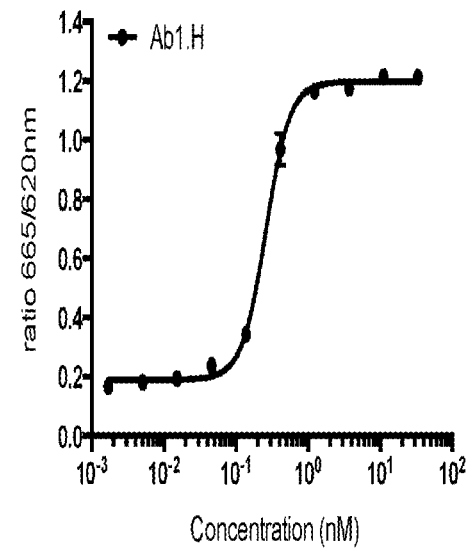
Figure 16U:
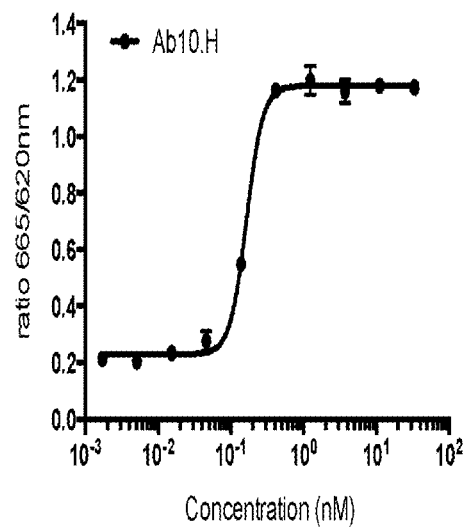
Figure 16V:
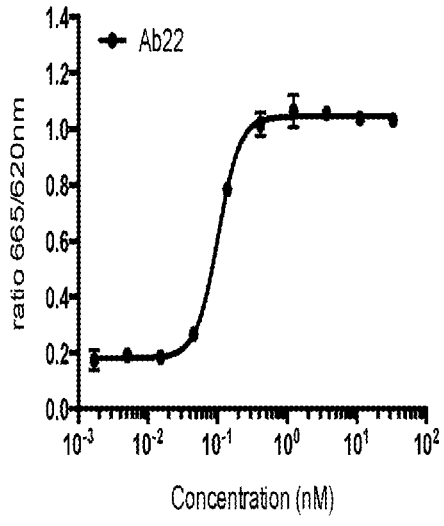
Figure 16W:
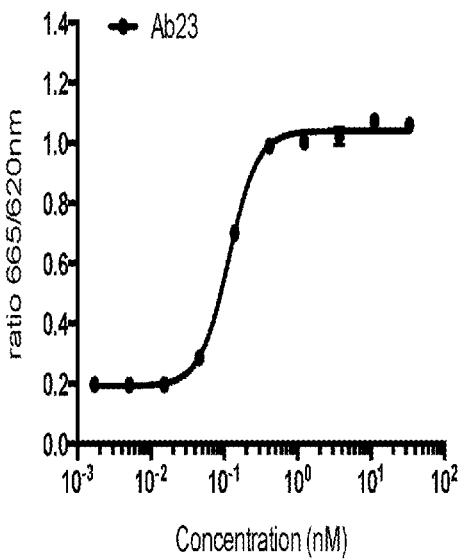
Figure 16X:
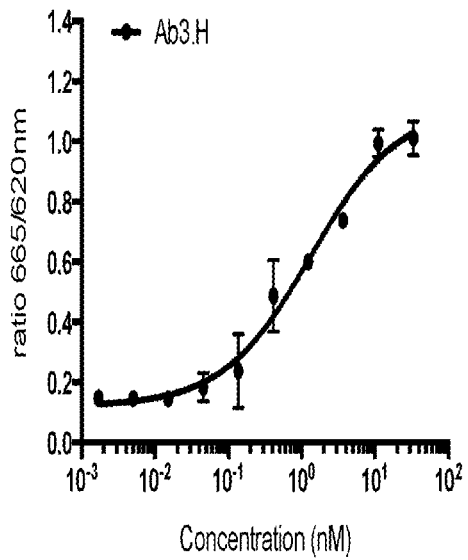
Figure 16Y:
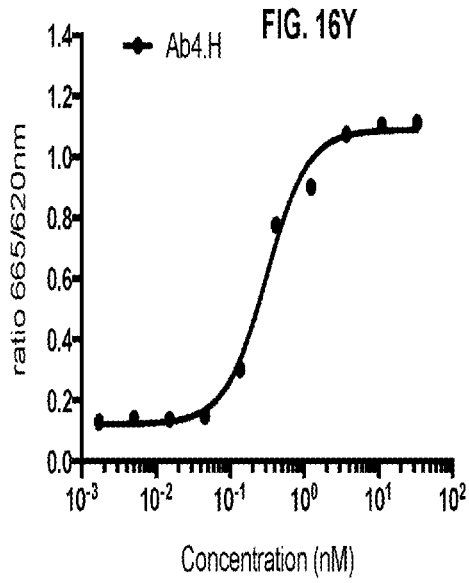
Figure 16Z:
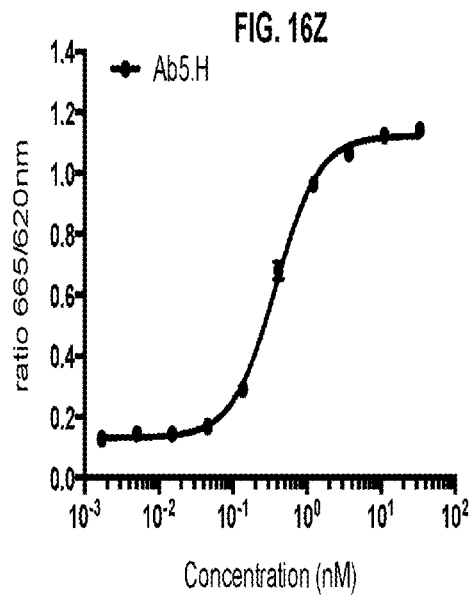
Figure 16A:
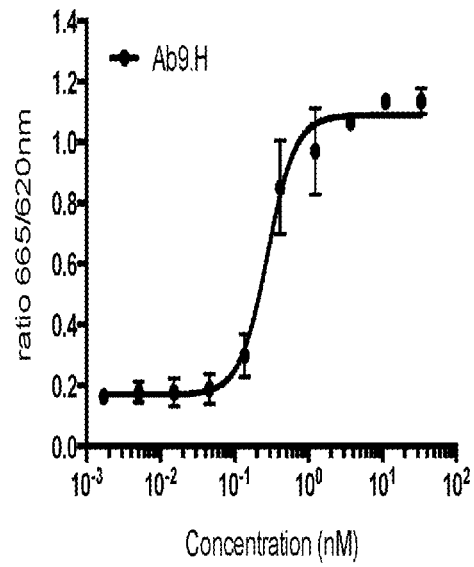
Figure 16B:
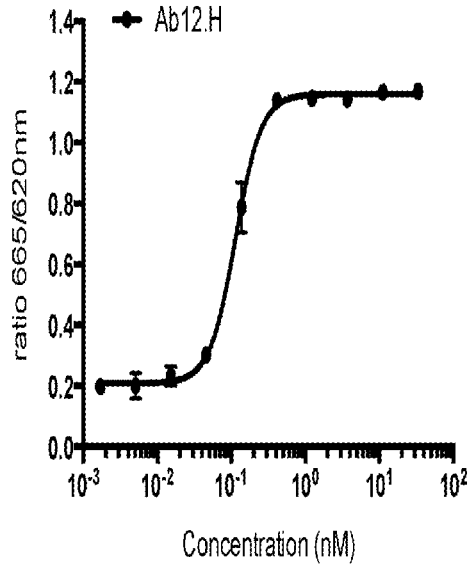
Figure 17A:
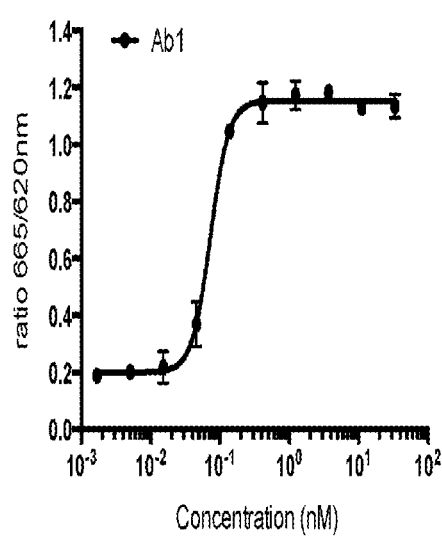
FIG. 17A-BB provides representative data showing Ab1-mediated (FIG. 17A), Ab2-mediated (FIG. 17B), Ab3-mediated (FIG. 17C), Ab4-mediated (FIG. 17D), Ab5-mediated (FIG. 17E), Ab6-mediated (FIG. 17F), Ab7-mediated (FIG. 17G), Ab8-mediated (FIG. 17H), Ab9-mediated (FIG. 17I), Ab10-mediated (FIG. 17J), Ab11-mediated (FIG. 17K), Ab12-mediated (FIG. 17L), Ab13-mediated (FIG. 17M), Ab14-mediated (FIG. 17N), Ab15-mediated (FIG. 17O), Ab16-mediated (FIG. 17P), Ab17-mediated (FIG. 17Q), Ab18-mediated (FIG. 17R), Ab19-mediated (FIG. 17S), Ab1.H-mediated (FIG. 17T), Ab10.H-mediated (FIG. 17U), Ab22-mediated (FIG. 17V), Ab23-mediated (FIG. 17W), Ab3.H-mediated (FIG. 17X), Ab4.H-mediated (FIG. 17Y), Ab5.H-mediated (FIG. 17Z), Ab9.H-mediated (FIG. 17AA), and Ab12.H-mediated (FIG. 17BB) inhibition of PACAP27-driven cAMP production via PAC1-R-expressing PC-12 cells obtained following the protocol in Example 1 infra.
Figure 17B:
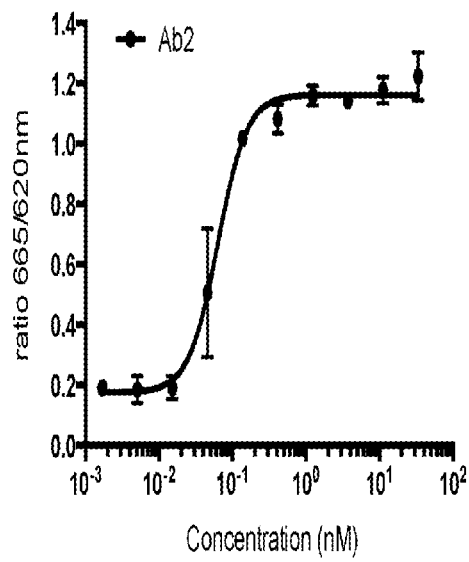
Figure 17C:
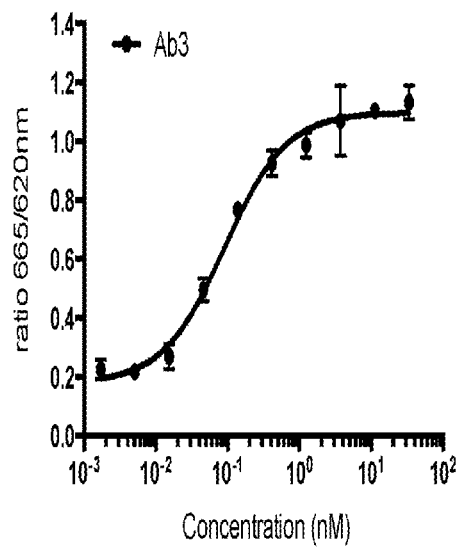
Figure 17D:
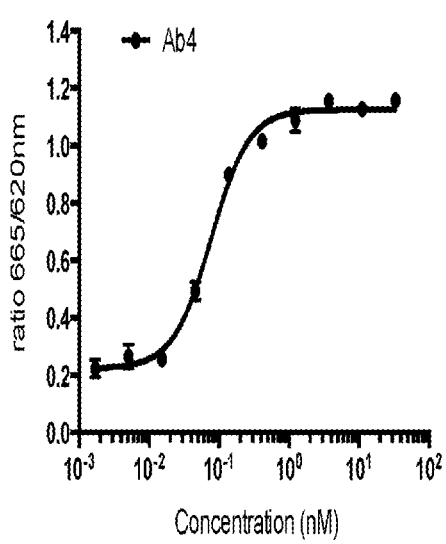
Figure 17E:
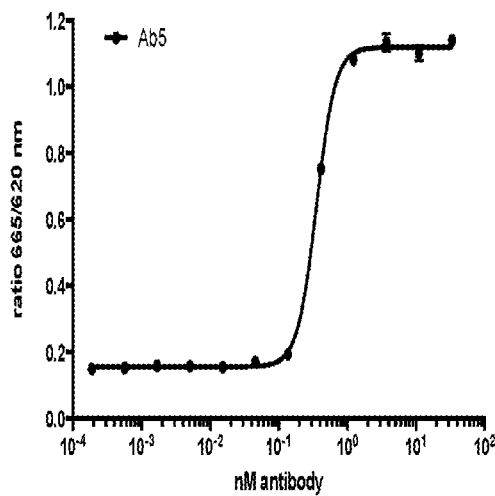
Figure 17F:
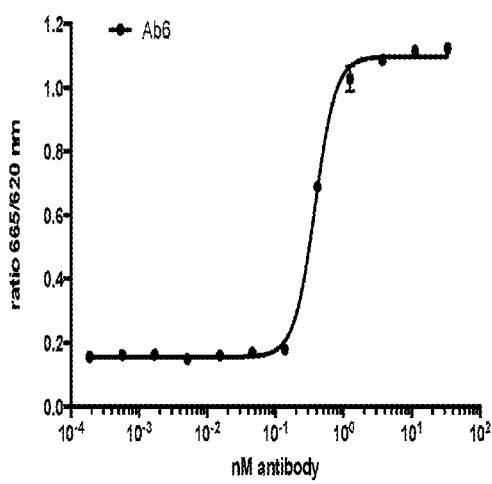
Figure 17G:
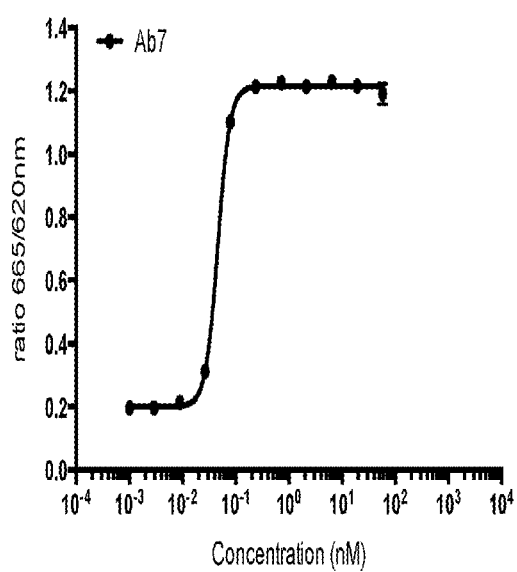
Figure 17H:
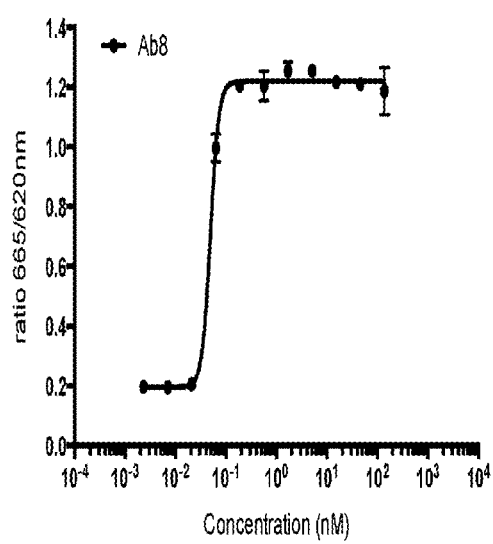
Figure 17I:
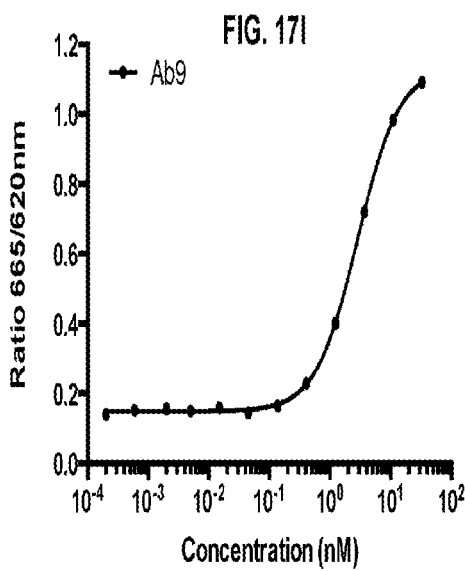
Figure 17J:
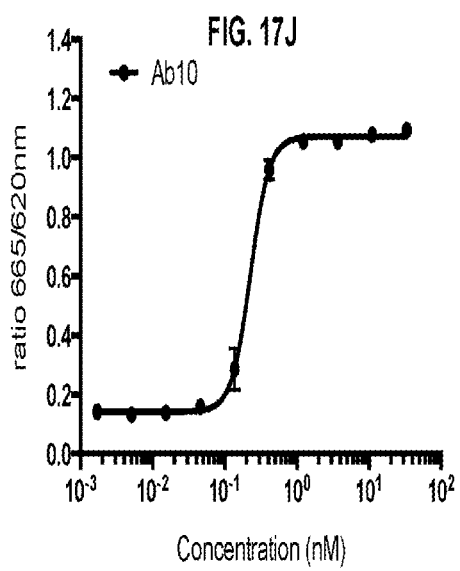
Figure 17K:
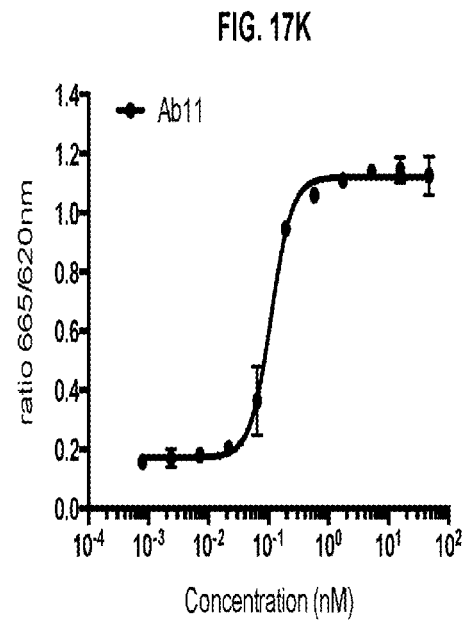
Figure 17L:
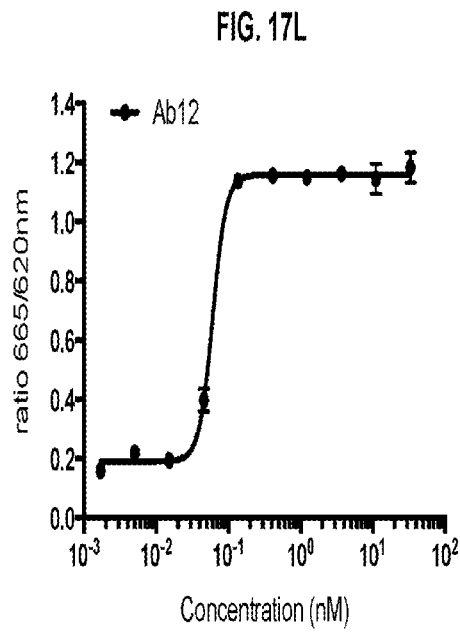
Figure 17M:
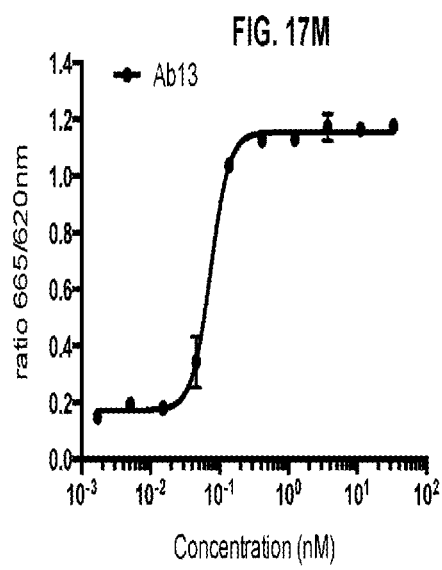
Figure 17N:
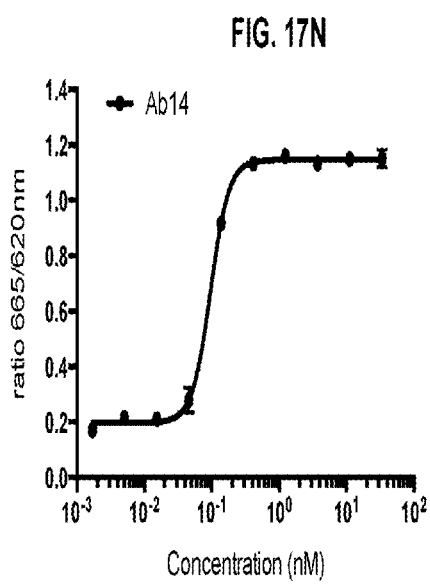
Figure 17O:
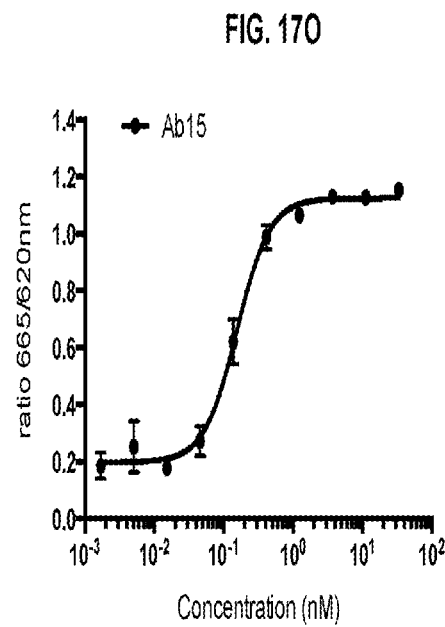
Figure 17P:
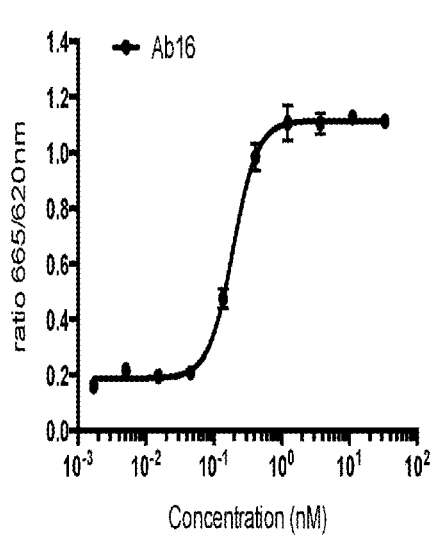
Figure 17Q:
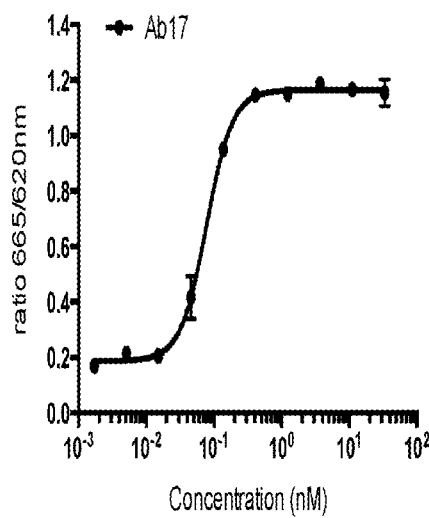
Figure 17R:
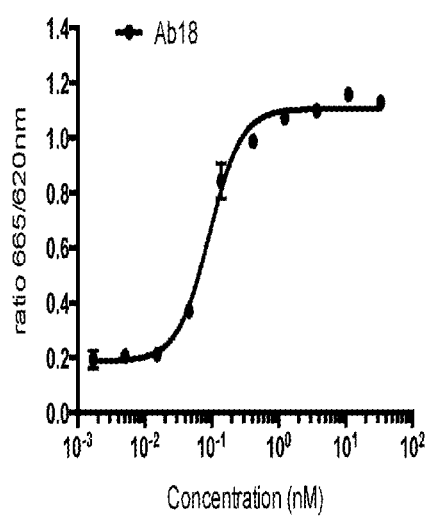
Figure 17S:
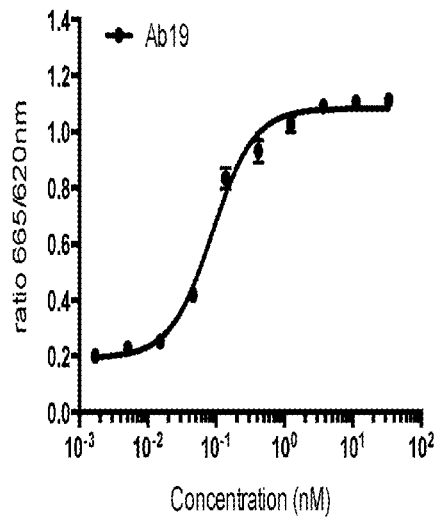
Figure 17T:
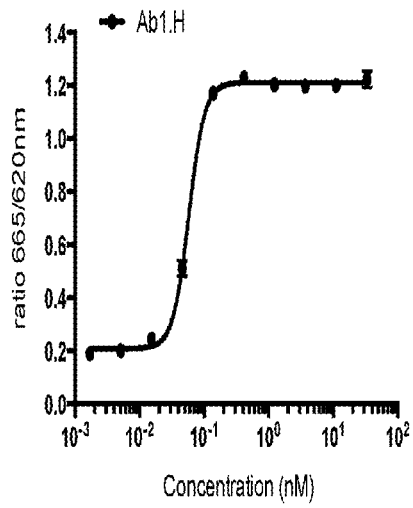
Figure 17U:
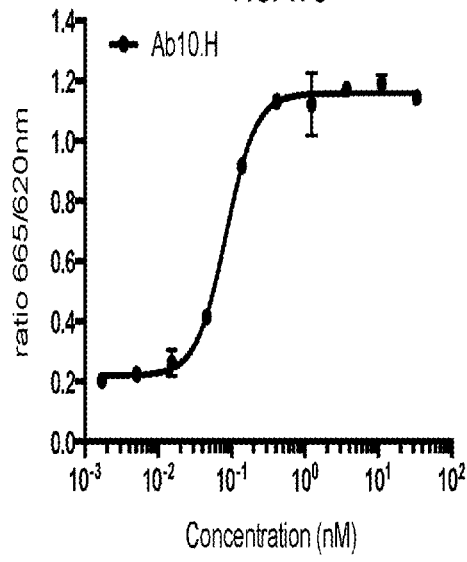
Figure 17V:
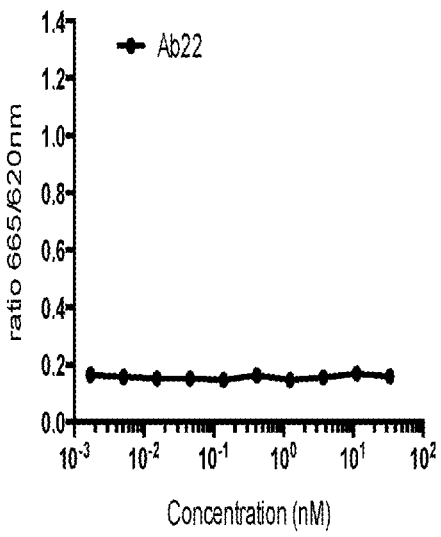
Figure 17W:
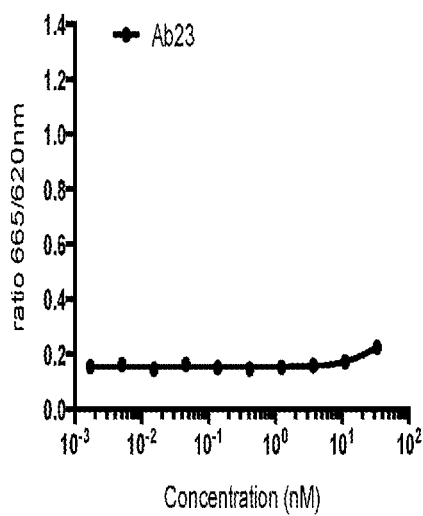
Figure 17X:
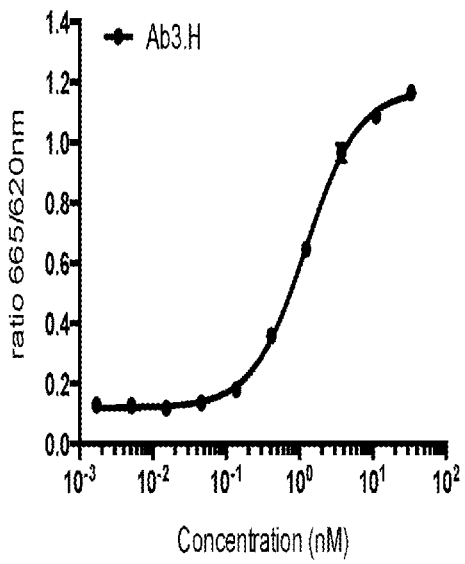
Figure 17Y:
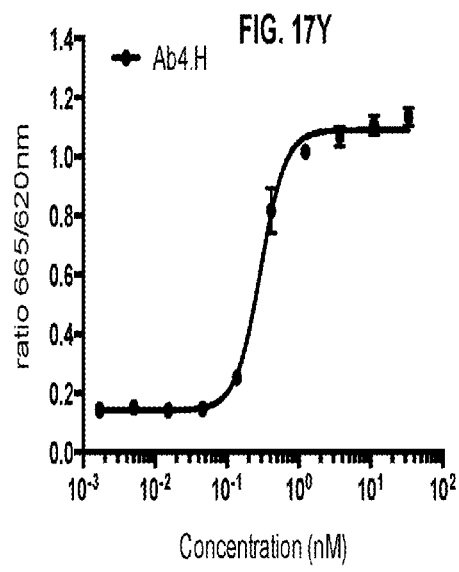
Figure 17Z:
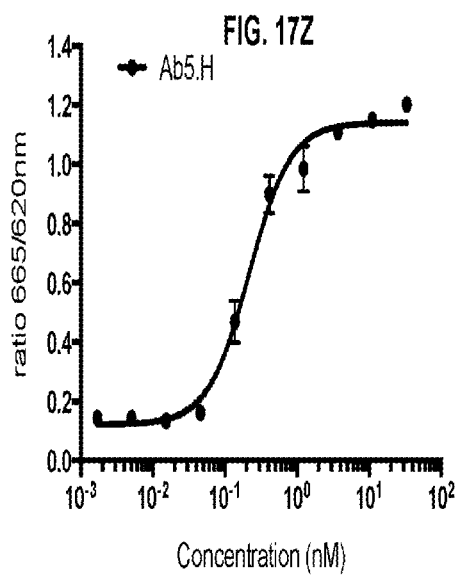
Figure 17A:
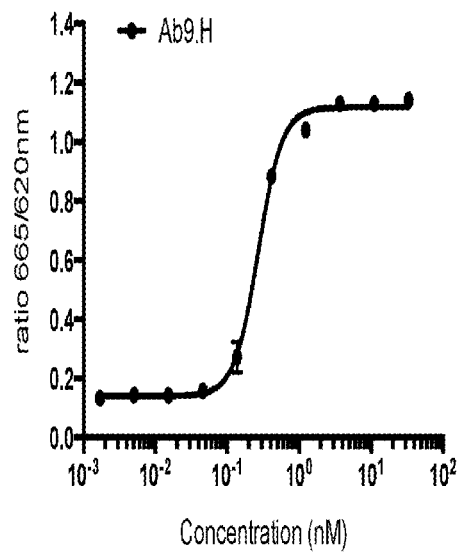
Figure 17B:
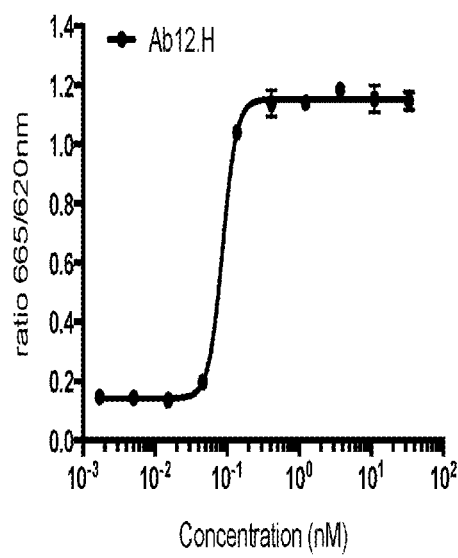

FIGS. 16A-16BB (PACAP38) and FIG. 17A-17BB (PACAP27) show inhibition curves (for Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab1.H, Ab10.H, Ab22, Ab23, Ab3.H, Ab4.H, Ab5.H, Ab9.H, and Ab12.H) that are representative of the inhibition curves that were obtained with the tested antibodies. The inhibition results were quantified for each antibody to yield an $IC_{50}$ value, which are summarized in Table 2 below. These results demonstrated that anti-PACAP antibodies Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab22, Ab23, Ab1.H, Ab10.H, Ab3.H, Ab4.H, Ab5.H, Ab9.H, and Ab12.H inhibited PACAP38-induced cAMP increase in cells expressing PAC1-R (see FIG. 16A-16BB). Additionally, these results demonstrated that anti-PACAP antibodies Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab1.H, Ab10.H, Ab3.H, Ab4.H, Ab5.H, Ab9.H, and Ab12.H, but not Ab22 or Ab23, inhibited PACAP27-induced cAMP increase in cells expressing PAC1-R (see FIG. 17A-17BB).

TABLE 2

Inhibition ($IC_{50}$) of PACAP38-induced and PACAP27-induced cAMP increase in cells expressing PAC1-R by anti-PACAP antibodies

| ANTIBODY | Inhibition of 0.1 nM PACAP38-induced PAC1-R mediated cAMP increase $IC_{50}$ (pM) | Inhibition of 0.1 nM PACAP27-induced PAC1-R mediated cAMP increase $IC_{50}$ (pM) |
| --- | --- | --- |
| Ab1 | 292.9 | 72.9 |
| Ab2 | 236.6 | 63.0 |
| Ab3 | 227.3 | 90.0 |
| Ab4 | 340.4 | 76.9 |
| Ab5 | 326.9 | 353.3 |
| Ab6 | 51.2 | 380.0 |
| Ab7 | 111.3 | 45.8 |
| Ab8 | 39.3 | 49.0 |
| Ab9 | 987.0 | 2840.0 |
| Ab10 | 180.3 | 227.0 |
| Ab11 | 56.7 | 109.3 |
| Ab12 | 51.1 | 60.4 |
| Ab13 | 82.4 | 74.1 |
| Ab14 | 154.4 | 95.7 |
| Ab15 | 162.0 | 155.5 |
| Ab16 | 211.8 | 192.4 |
| Ab17 | 97.7 | 77.6 |
| Ab18 | 117.7 | 91.6 |
| Ab19 | 100.8 | 87.4 |
| Ab1.H | 259.6 | 57.7 |
| Ab10.H | 163.4 | 84.0 |
| Ab22 | 101.4 | n/a * |
| Ab23 | 114.9 | n/a * |
| Ab3.H | 1320.0 | 1207.0 |
| Ab4.H | 307.0 | 293.6 |
| Ab5.H | 378.4 | 216.8 |
| Ab9.H | 278.0 | 270.5 |
| Ab12.H | 113.9 | 86.3 |

* n/a: not active because these Abs are PACAP38 specific

Example 2

Binding Affinities of Anti-PACAP Antibodies

Binding affinities of monoclonal antibodies for human PACAP were estimated using SPR on the PROTEON™ XPR36 (Bio-Rad, Hercules, Calif.). Antibody was immobilized to the surface of general amine coupling ("GLC" or "GLM") Chips (Bio-Rad, Hercules, Calif.). A dilution series of human PACAP38 (SEQ ID NO: 1241) prepared in 1×PBST Buffer (4.3 mM Na Phosphate, 1.4 mM K Phosphate, 135 mM NaCl, 2.7 mM KCl 0.05% Polysorbate-20) purchased from Teknova (Cat# P1192, Teknova, Hollister, Calif.) and supplemented with 0.25 M arginine (from J.T. BAKER®), 0.2 mg/ml BSA (Jackson Immuno Research Labs, West Grove, Pa.), and 0.005% sodium azide (VWR International, Radnor, Pa.) with the pH adjusted to 7 was used to query the antibodies. Antigen (ranging from 1.23 nM to 100 nM) was typically run sequentially with association times of 2-4 minutes and dissociation times of 3-120 minutes grouped with the PROTEON™ Manager Software (v3.1.0.6 (Bio-Rad, Hercules, Calif.)) and fitted using a 1:1 Langmuir binding model. Surfaces were regenerated between analyte queries using 0.85% Phosphoric Acid. A single $K_D$ was calculated for each antibody with association times limited near the rate of diffusion ($1.0\times10^6$) and dissociation times limited to $1.5\times10^{-5}$ where no discernible dissociation was observed.

The same procedure was used to determine binding affinities of antibodies for human VIP (SEQ ID NO: 1243) and PACAP27 (SEQ ID NO: 1242) though peptide concentrations ranged from 1.23 nM to 1000 nM with association times of 200 seconds and dissociation times of 3-120 minutes.

The measured antibody affinities for PACAP38 are listed in Table 3.

TABLE 3

Antibody affinity constants for PACAP38

| Antibody | ka (1/Ms) | kd (1/s) | $K_D$ (M) |
| --- | --- | --- | --- |
| Ab1 | 3.7E+05 | 1.0E−05 | 2.7E−11 |
| Ab2 | 2.3E+05 | 1.0E−05 | 4.4E−11 |
| Ab3 | 2.6E+05 | 4.2E−05 | 1.6E−10 |
| Ab4 | 3.3E+05 | 7.2E−05 | 2.2E−10 |
| Ab5 | 2.4E+05 | 1.0E−05 | 4.1E−11 |
| Ab6 | 3.0E+05 | 4.1E−05 | 1.4E−10 |
| Ab7 | 1.8E+05 | 1.0E−05 | 5.6E−11 |
| Ab8 | 3.5E+05 | 1.0E−05 | 2.9E−11 |
| Ab9 | 8.2E+05 | 1.1E−04 | 1.4E−10 |
| Ab10 | 2.6E+05 | 2.0E−05 | 7.5E−11 |
| Ab11 | 2.7E+05 | 3.1E−05 | 1.1E−10 |
| Ab12 | 3.1E+05 | 1.0E−05 | 3.2E−11 |
| Ab13 | 4.2E+05 | 2.7E−05 | 6.4E−11 |

TABLE 3-continued

Antibody affinity constants for PACAP38

| Antibody | ka (1/Ms) | kd (1/s) | $K_D$ (M) |
|---|---|---|---|
| Ab14 | 3.2E+05 | 1.0E−05 | 3.1E−11 |
| Ab15 | 5.3E+05 | 2.7E−05 | 5.0E−11 |
| Ab16 | 9.1E+05 | 1.0E−05 | 1.1E−11 |
| Ab17 | 5.0E+05 | 1.0E−05 | 2.0E−11 |
| Ab18 | 4.3E+05 | 1.0E−05 | 2.3E−11 |
| Ab19 | 2.7E+05 | 2.5E−05 | 9.3E−11 |
| Ab22 | 3.7E+05 | 1.0E−05 | 2.7E−11 |
| Ab23 | 5.1E+05 | 3.6E−05 | 7.1E−11 |
| Ab1.H | 4.7E+05 | 1.0E−05 | 2.1E−11 |
| Ab3.H | 4.9E+05 | 1.4E−04 | 2.9E−10 |
| Ab4.H | 3.1E+05 | 3.2E−05 | 1.0E−10 |
| Ab5.H | 5.5E+05 | 1.7E−05 | 3.1E−11 |
| Ab9.H | 1.0E+06 | 6.1E−05 | 6.1E−11 |
| Ab10.H | 3.4E+05 | 1.0E−05 | 2.9E−11 |
| Ab12.H | 3.8E+05 | 1.0E−05 | 2.6E−11 |

Examples of antibody affinity constants for VIP are listed in Table 4.

TABLE 4

Antibody affinity constants for VIP

| Antibody | ka (1/Ms) | kd (1/s) | $K_D$ (M) |
|---|---|---|---|
| Ab1 | 2.5E+05 | 2.5E−02 | 9.9E−08 |
| Ab2 | 5.8E+05 | 8.4E−02 | 1.4E−07 |
| Ab3 | 1.0E+00 | 1.0E−01 | 1.0E−01 |
| Ab4 | 1.7E+05 | 2.1E−02 | 1.2E−07 |
| Ab5 | 1.2E+05 | 8.6E−01 | 7.2E−06 |
| Ab6 | 3.1E+03 | 1.4E−04 | 4.4E−08 |
| Ab7 | 2.6E+05 | 8.8E−03 | 3.4E−08 |
| Ab8 | 4.8E+05 | 1.0E−01 | 2.1E−07 |
| Ab9 | 1.0E+00 | 1.0E−01 | 1.0E−01 |
| Ab10 | 3.7E+04 | 1.0E−02 | 2.8E−07 |
| Ab11 | 2.0E+05 | 4.7E−02 | 2.3E−07 |
| Ab12 | 2.9E+05 | 2.4E−03 | 8.2E−09 |
| Ab13 | 3.2E+05 | 4.6E−02 | 1.4E−07 |
| Ab14 | 2.7E+05 | 6.7E−02 | 2.5E−07 |
| Ab15 | 1.6E+05 | 1.3E−01 | 8.2E−07 |
| Ab16 | 3.6E+05 | 9.6E−02 | 2.6E−07 |
| Ab17 | 3.1E+05 | 1.7E−02 | 5.5E−08 |
| Ab18 | 3.1E+05 | 1.2E−01 | 4.0E−07 |
| Ab19 | 2.8E+05 | 2.8E−01 | 1.0E−06 |
| Ab22 | 2.7E+05 | 1.8E−01 | 6.9E−07 |
| Ab23 | 4.3E+05 | 3.2E−01 | 7.3E−07 |
| Ab1.H | 3.8E+04 | 1.8E−01 | 4.8E−06 |
| Ab3.H | 1.0E+00 | 1.0E−01 | 1.0E−01 |
| Ab4.H | 3.3E+05 | 2.4E−02 | 7.2E−08 |
| Ab5.H | 1.0E+00 | 1.0E−01 | 1.0E−01 |
| Ab9.H | 9.3E+04 | 1.4E−01 | 1.5E−06 |
| Ab10.H | 3.8E+05 | 3.9E−02 | 1.0E−07 |
| Ab12.H | 2.8E+05 | 1.4E−02 | 5.1E−08 |

Examples of antibody affinity constants for PACAP27 are listed in Table 5.

TABLE 5

Antibody affinity constants for PACAP27

| Antibody | ka (1/Ms) | kd (1/s) | $K_D$ (M) |
|---|---|---|---|
| Ab1 | 1.0E+06 | 1.0E−05 | 1.0E−11 |
| Ab2 | 8.3E+05 | 1.0E−05 | 1.2E−11 |
| Ab3 | 3.7E+05 | 1.4E−04 | 3.7E−10 |
| Ab4 | 3.9E+05 | 2.0E−04 | 5.1E−10 |
| Ab5 | 2.5E+05 | 2.4E−05 | 9.6E−11 |
| Ab6 | 3.9E+05 | 8.2E−05 | 2.1E−10 |
| Ab7 | 2.3E+05 | 4.5E−05 | 2.0E−10 |
| Ab8 | 4.4E+05 | 6.0E−05 | 1.4E−10 |
| Ab9 | 9.6E+05 | 3.2E−04 | 3.4E−10 |

TABLE 5-continued

Antibody affinity constants for PACAP27

| Antibody | ka (1/Ms) | kd (1/s) | $K_D$ (M) |
|---|---|---|---|
| Ab10 | 1.0E+06 | 1.0E−05 | 1.0E−11 |
| Ab11 | 2.6E+05 | 1.1E−04 | 4.2E−10 |
| Ab12 | 2.9E+05 | 2.1E−05 | 7.0E−11 |
| Ab13 | 5.4E+05 | 6.6E−05 | 1.2E−10 |
| Ab14 | 2.7E+05 | 2.0E−05 | 7.4E−11 |
| Ab15 | 4.7E+05 | 7.8E−05 | 1.7E−10 |
| Ab16 | 8.2E+05 | 2.9E−05 | 3.5E−11 |
| Ab17 | 3.7E+05 | 1.0E−05 | 2.7E−11 |
| Ab18 | 4.4E+05 | 1.0E−05 | 2.3E−11 |
| Ab19 | 4.2E+05 | 1.3E−04 | 3.1E−10 |
| Ab22 | 1.0E+00 | 1.0E−01 | 1.0E−01 |
| Ab23 | 8.9E+05 | 3.1E−02 | 3.5E−08 |
| Ab1.H | 7.6E+05 | 1.0E−05 | 1.3E−11 |
| Ab3.H | 3.3E+05 | 3.4E−04 | 1.0E−09 |
| Ab4.H | 3.3E+05 | 1.0E−05 | 3.1E−11 |
| Ab5.H | 2.7E+05 | 1.3E−04 | 4.8E−10 |
| Ab9.H | 6.2E+05 | 7.7E−05 | 1.2E−10 |
| Ab10.H | 5.3E+05 | 1.8E−05 | 3.3E−11 |
| Ab12.H | 2.6E+05 | 7.9E−05 | 3.0E−10 |

The binding affinity results of Tables 3 and 5 present data demonstrating that Ab23 weakly bound to PACAP27 as compared to its binding affinity for PACAP38. Tables 3 and 5 additionally present data demonstrating that Ab22 did not specifically recognize PACAP27, but that Ab22 specifically bound to PACAP38.

Example 3

Inhibition of PACAP38-Induced Signaling Via VPAC1-R

To identify antibodies that neutralize PACAP38-induced signaling via human VPAC1-R, CHO-K1 cells expressing human VPAC1-R were used in a cAMP HTRF cell-based assay. Antibody dilutions were incubated with PACAP38 at 4× the final concentration (5 nM) for 1 hour. While the antibody/antigen complexes were incubated for 1 hour, VPAC1-R expressing CHO-K1 cells (generated at Alder Biopharmaceuticals, by stable transfection of CHO-K1 cells (ATCC, catalog # CCL-61) with human VPAC1-R cDNA; selected clone 1 was used for in vitro cell based assays) were detached with 0.25% trypsin for 4 minutes. The cells were washed and re-suspended at 1×10⁶ cells per ml culture media. 20 µl of Ab/antigen mixture was mixed with 20 µl of cells in HTRF plates and incubated with shaking for 30 minutes. 20 µl of $Eu^{3+}$ cryptate labeled anti-cAMP mAb (1:20 diluted) and 20 µl of (1:20 diluted) d2-labeled cAMP in lysis buffer were added to each well and incubated for 1 hour with shaking. The final concentration of PACAP38 in each well was 5 nM. Following incubation, plates were read (excitation 330 nm, emission 620/665 nm), and a ratio of 620:665 signal was determined.

Figure 18A:
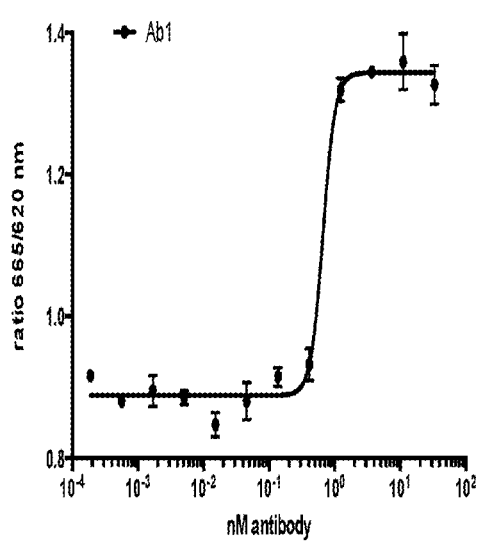
FIG. 18A-BB provides representative data showing Ab1-mediated (FIG. 18A), Ab2-mediated (FIG. 18B), Ab3-mediated (FIG. 18C), Ab4-mediated (FIG. 18D), Ab5-mediated (FIG. 18E), Ab6-mediated (FIG. 18F), Ab7-mediated (FIG. 18G), Ab8-mediated (FIG. 18H), Ab9-mediated (FIG. 18I), Ab10-mediated (FIG. 18J), Ab11-mediated (FIG. 18K), Ab12-mediated (FIG. 18L), Ab13-mediated (FIG. 18M), Ab14-mediated (FIG. 18N), Ab15-mediated (FIG. 18O), Ab16-mediated (FIG. 18P), Ab17-mediated (FIG. 18Q), Ab18-mediated (FIG. 18R), Ab19-mediated (FIG. 18S), Ab1.H-mediated (FIG. 18T), Ab10.H-mediated (FIG. 18U), Ab22-mediated (FIG. 18V), Ab23-mediated (FIG. 18W), Ab3.H-mediated (FIG. 18X), Ab4.H-mediated (FIG. 18Y), Ab5.H-mediated (FIG. 18Z), Ab9.H-mediated (FIG. 18AA), and Ab12.H-mediated (FIG. 18BB) inhibition of PACAP38-driven cAMP production via VPAC1-R-expressing CHO-K1 cells obtained following the protocol in Example 3 infra.
Figure 18B:
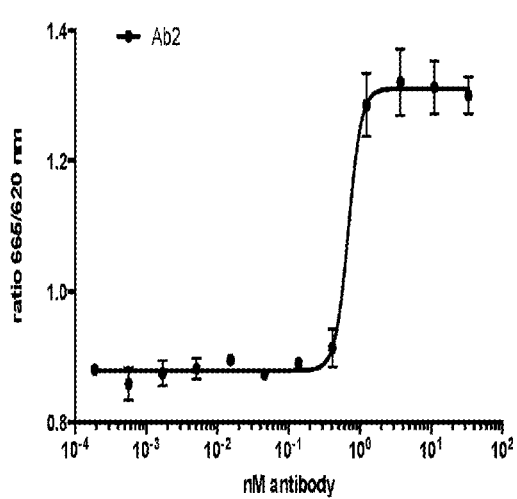
Figure 18C:
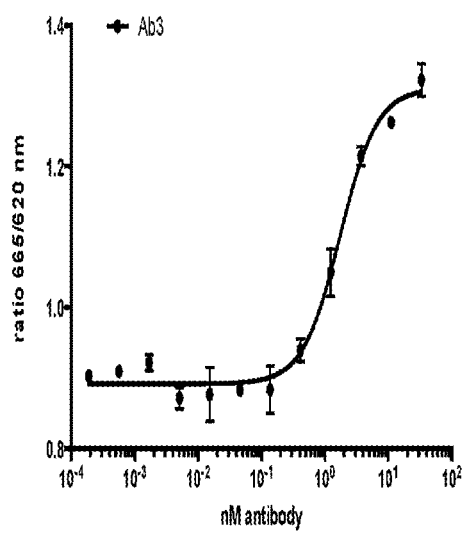
Figure 18D:
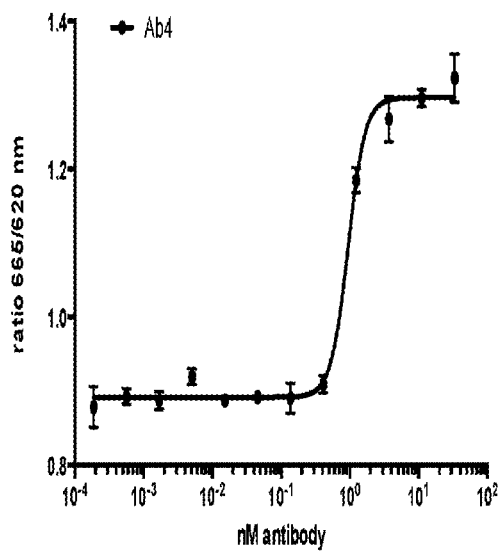
Figure 18E:
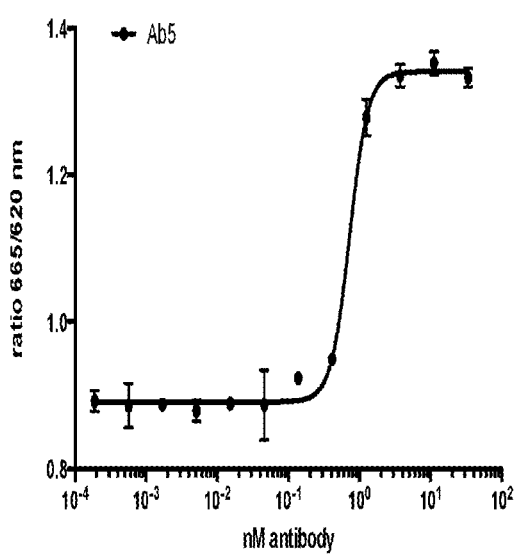
Figure 18F:
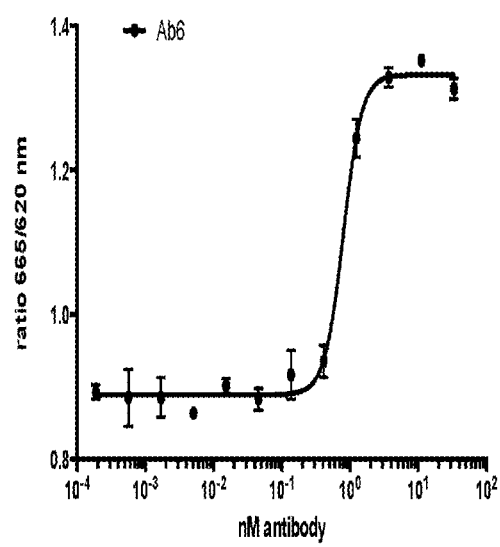
Figure 18G:
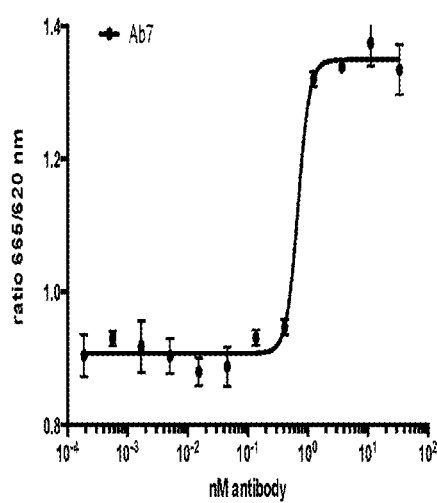
Figure 18H:
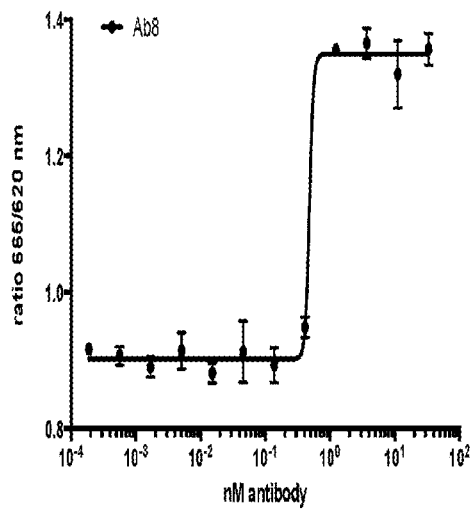
Figure 18I:
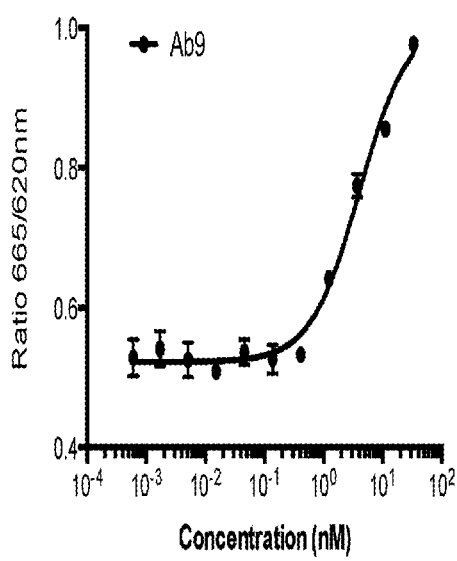
Figure 18J:
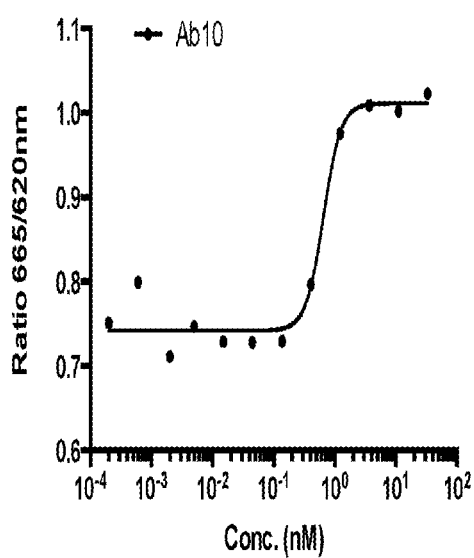
Figure 18K:
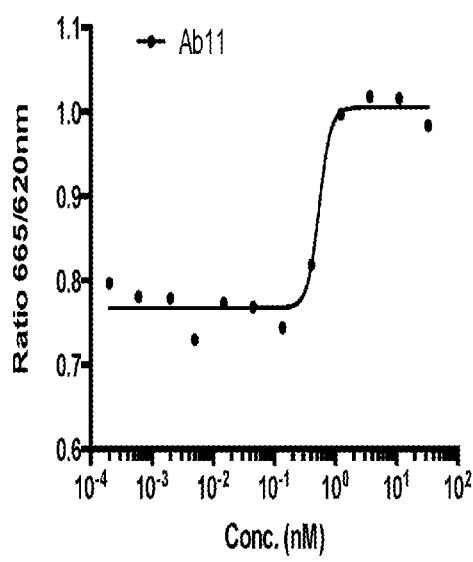
Figure 18L:
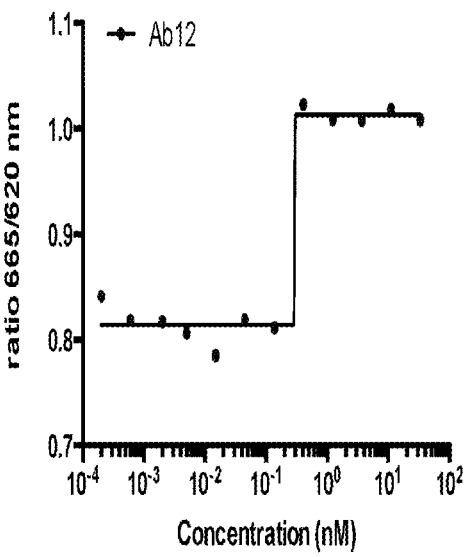
Figure 18M:
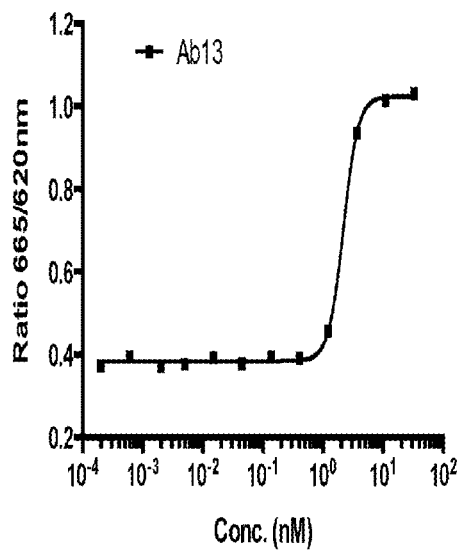
Figure 18N:
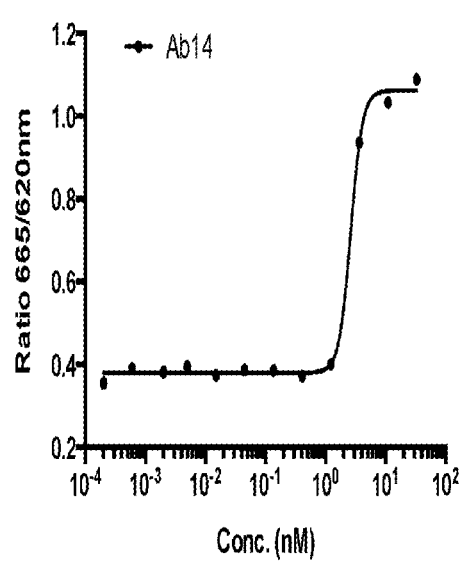
Figure 18O:
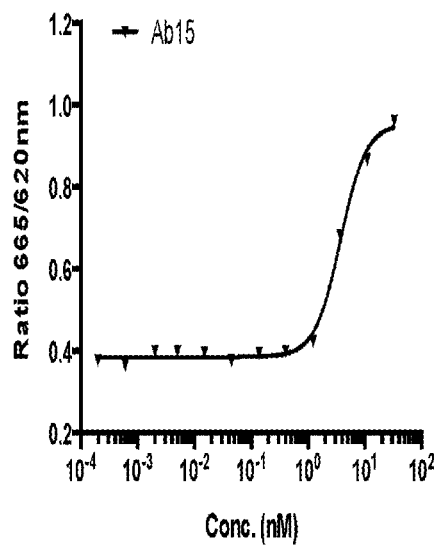
Figure 18P:
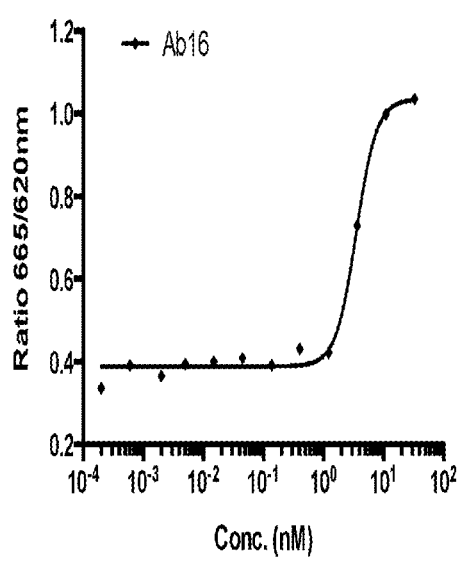
Figure 18U:
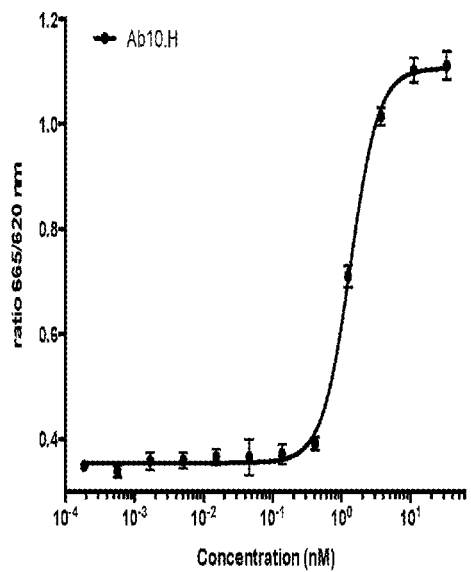
Figure 18V:
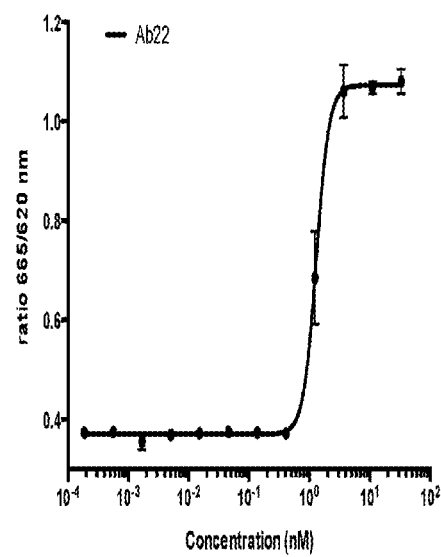
Figure 18W:
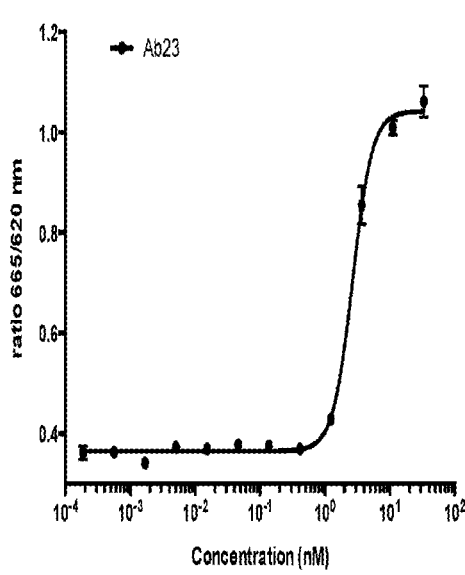
Figure 18X:
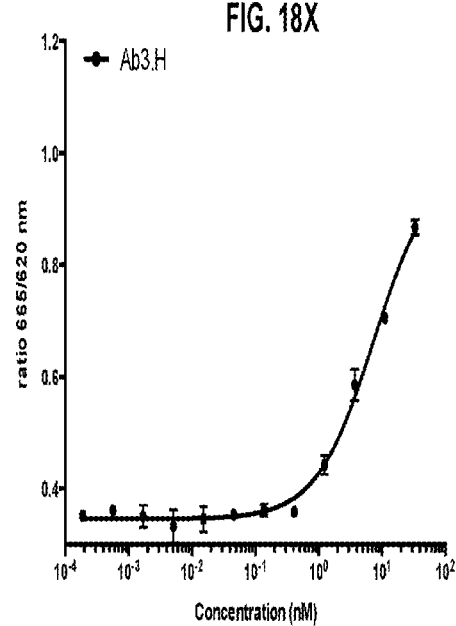
Figure 18Y:
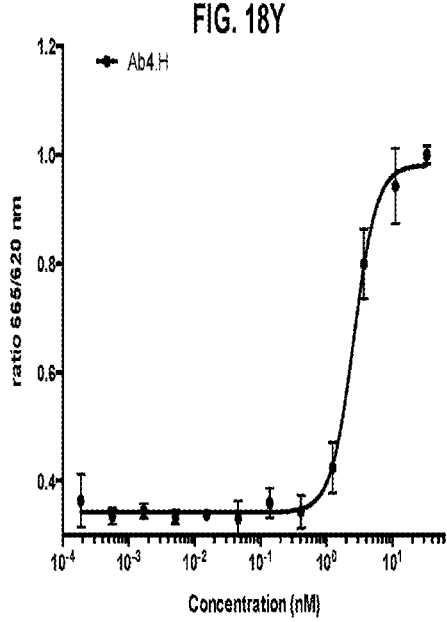
Figure 18Z:
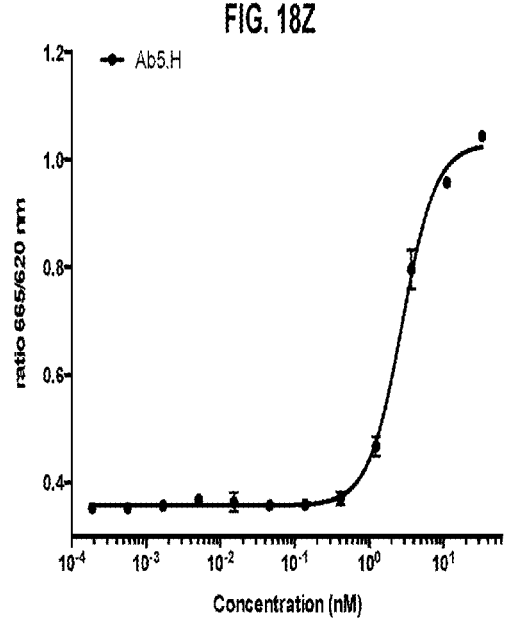
Figure 18A:
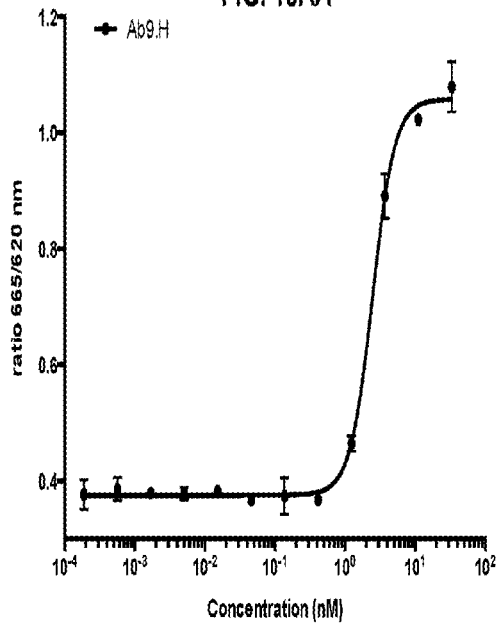
Figure 18B:
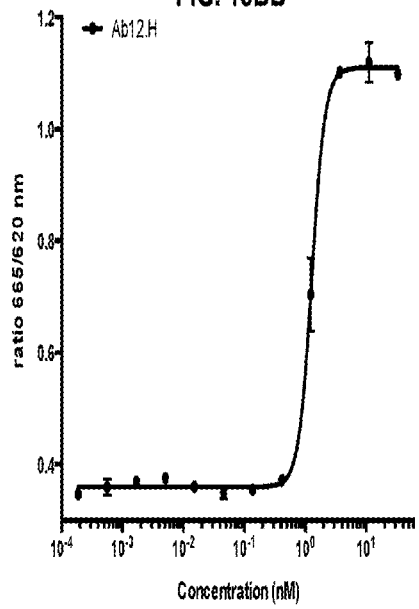

FIGS. 18A-18BB are representative of the inhibition curves obtained by this method (results are shown for Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab1.H, Ab10.H, Ab22, Ab23, Ab3.H, Ab4.H, Ab5.H, Ab9.H, and Ab12.H, respectively). The computed $IC_{50}$ values for each antibody, which are shown below in Table 6, demonstrated that Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab1.H, Ab10.H, Ab22, Ab23, Ab3.H, Ab4.H, Ab5.H, Ab9.H, and Ab12.H inhibited PACAP38-induced cAMP increase in cells expressing human VPAC1-R.

TABLE 6

Inhibition (IC$_{50}$) of PACAP38-induced cAMP increase in cells expressing human VPAC1-R by anti-PACAP antibodies

| ANTIBODY | Inhibition of 5 nM PACAP38-induced human VPAC1-R mediated cAMP increase IC$_{50}$ (pM) |
|---|---|
| Ab1 | 664.7 |
| Ab2 | 688.3 |
| Ab3 | 1736.0 |
| Ab4 | 942.8 |
| Ab5 | 720.7 |
| Ab6 | 797.1 |
| Ab7 | 687.3 |
| Ab8 | 481.2 |
| Ab9 | 4059.0 |
| Ab10 | 649.1 |
| Ab11 | 541.0 |
| Ab12 | 292.2 |
| Ab13 | 2183.0 |
| Ab14 | 2626.0 |
| Ab15 | 3715.0 |
| Ab16 | 3533.0 |
| Ab17 | 780.1 |
| Ab18 | 911.2 |
| Ab19 | 826.8 |
| Ab1.H | 1021.1 |
| Ab10.H | 1336.0 |
| Ab22 | 1300.0 |
| Ab23 | 2667.0 |
| Ab3.H | 7332.0 |
| Ab4.H | 2600.0 |
| Ab5.H | 2772.0 |
| Ab9.H | 2465.0 |
| Ab12.H | 1284.0 |

Example 4

Inhibition of PACAP38-Induced Signaling Via VPAC2-R

To identify antibodies that neutralize PACAP38-induced signaling via human VPAC2-R, CHO-K1 cells expressing human VPAC2-R were used in a cAMP HTRF cell based assay. Antibody dilutions were incubated with PACAP38 at 4× the final concentration (1 nM) for 1 hr. While the antibody/antigen complexes were incubated for 1 hour, VPAC2-R expressing CHO-K1 cells (generated at Alder Biopharmaceuticals, by stable transfection of CHO-K1 cells (ATCC, catalog # CCL-61) with human VPAC2-R cDNA; selected clone 8 was used for in vitro cell based assays) were detached with 0.25% trypsin for 4 minutes. The cells were washed and re-suspended at 1×10$^6$ cells per ml culture media. 20 µl of Ab/antigen mixture was mixed with 20 µl of cells in HTRF plates and incubated with shaking for 30 minutes. 20 µl of Eu$^{3+}$ cryptate labeled anti-cAMP mAb (1:20 diluted) and 20 µl of (1:20 diluted) d2-labeled cAMP in lysis buffer were added to each well and incubated for 1 hour with shaking. The final concentration of PACAP38 in the wells was 1 nM. Following incubation, plates were read (excitation 330 nm, emission 620/665 nm) and, a ratio of 620:665 signal was determined.

Figure 19A:
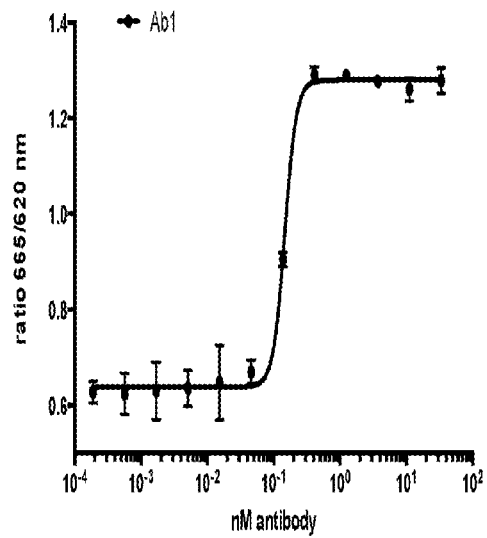
FIG. 19A-BB provides representative data showing Ab1-mediated (FIG. 19A), Ab2-mediated (FIG. 19B), Ab3-mediated (FIG. 19C), Ab4-mediated (FIG. 19D), Ab5-mediated (FIG. 19E), Ab6-mediated (FIG. 19F), Ab7-mediated (FIG.
Figure 19B:
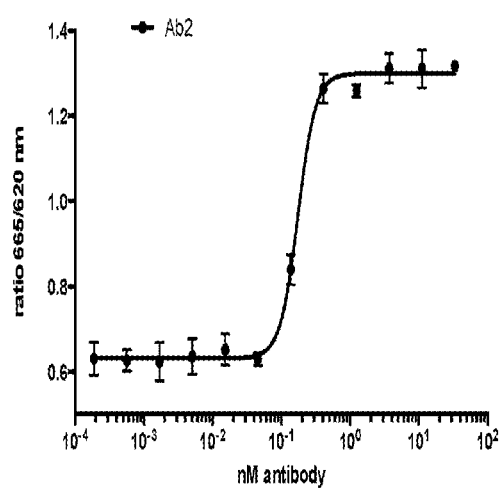
Figure 19C:
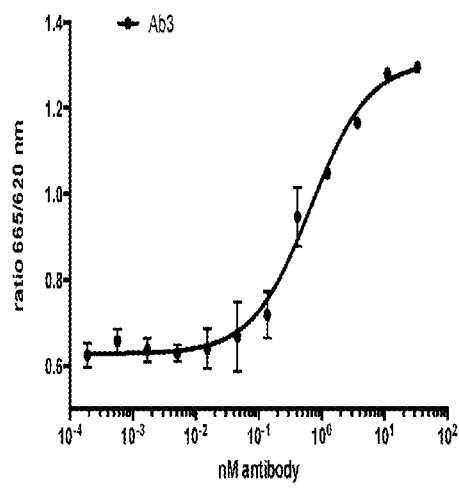
Figure 19D:
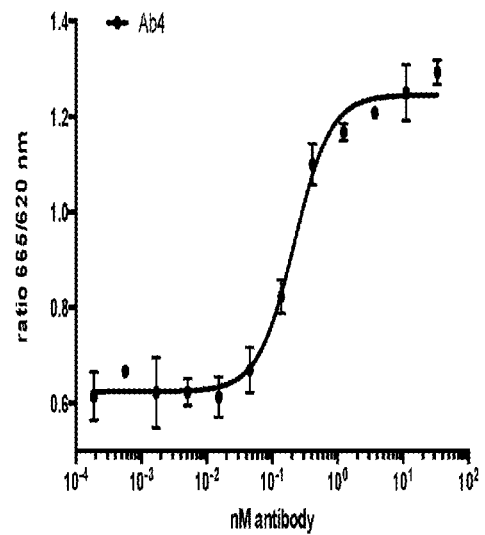
Figure 19I:
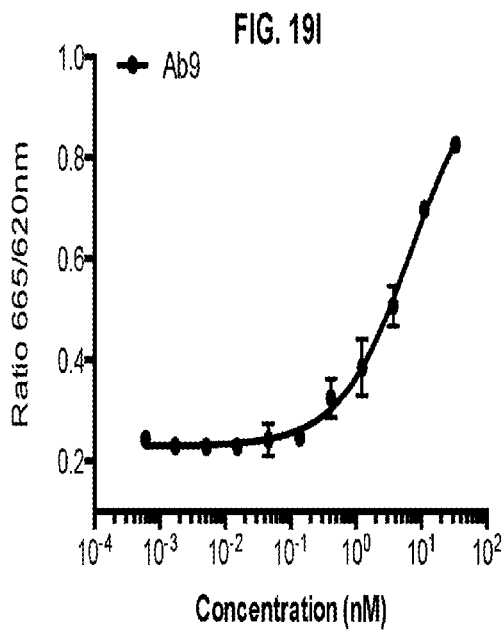
Figure 19J:
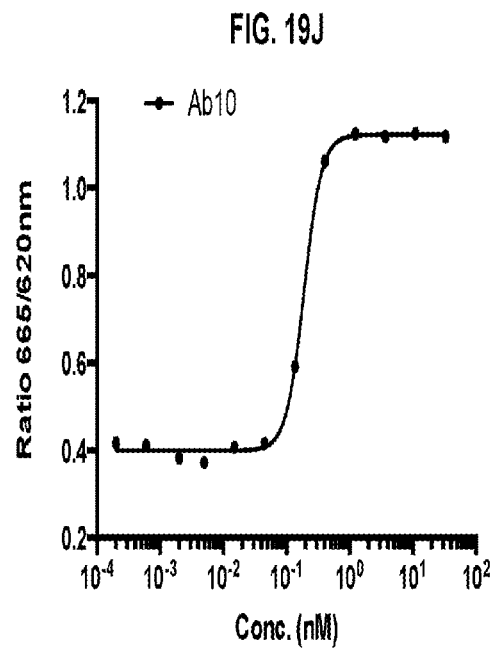
Figure 19K:
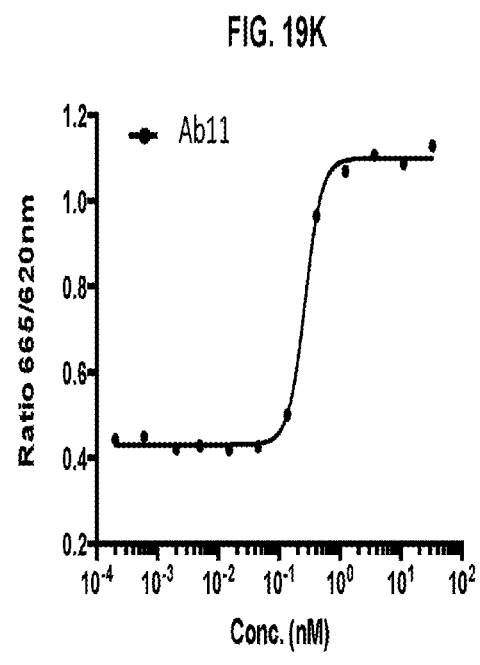
Figure 19L:
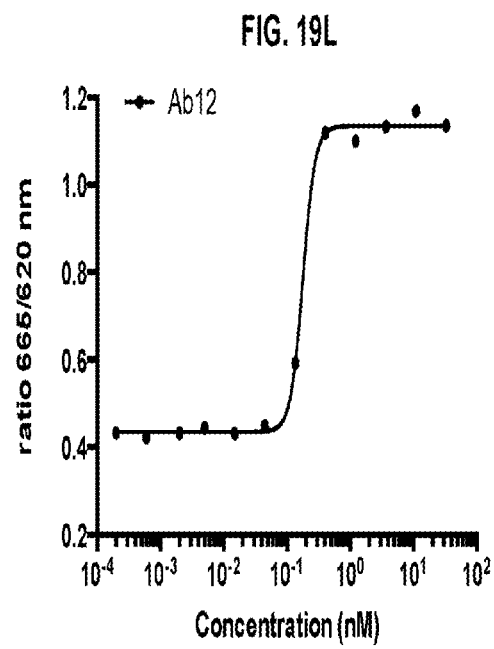
Figure 19M:
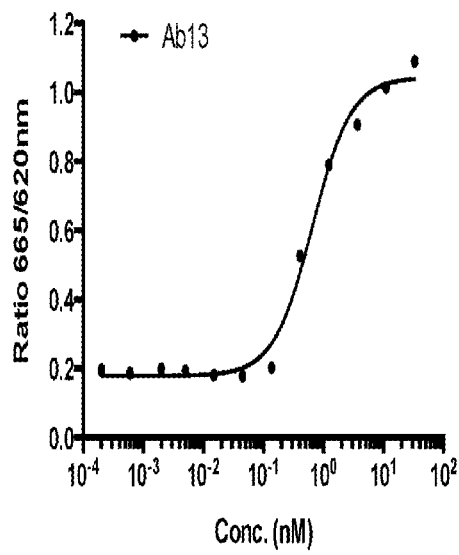
Figure 19N:
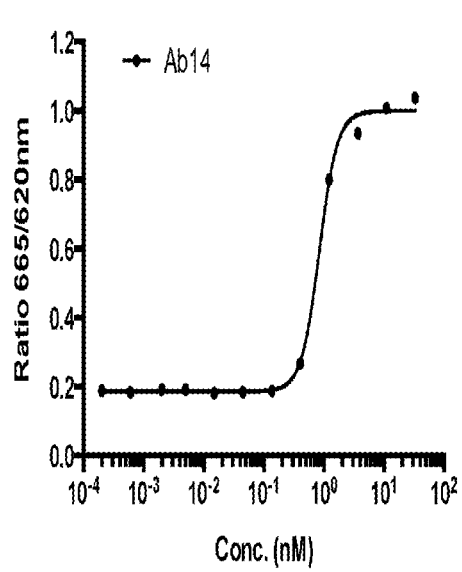
Figure 19O:
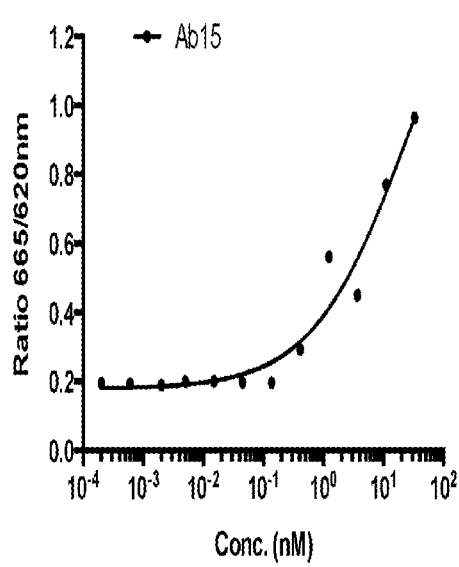
Figure 19P:
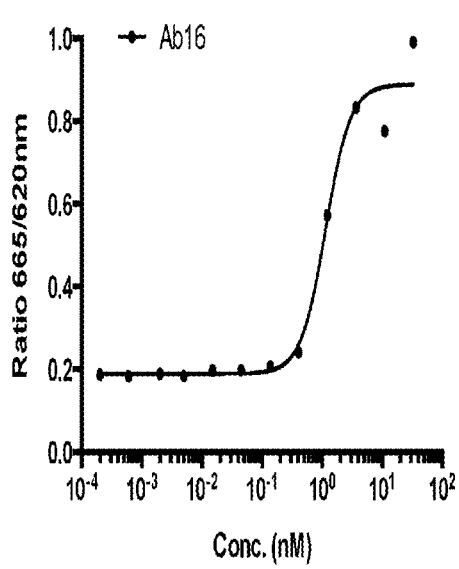
Figure 19Q:
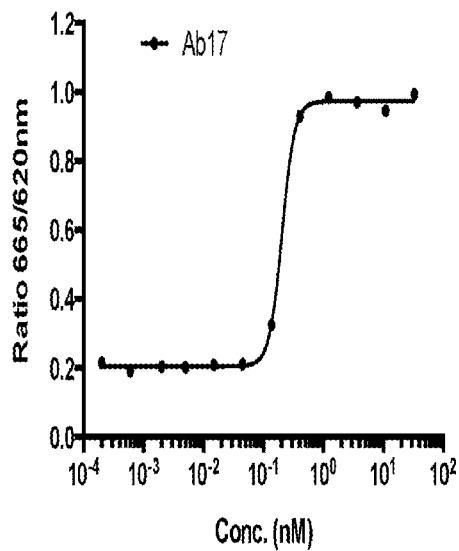
Figure 19R:
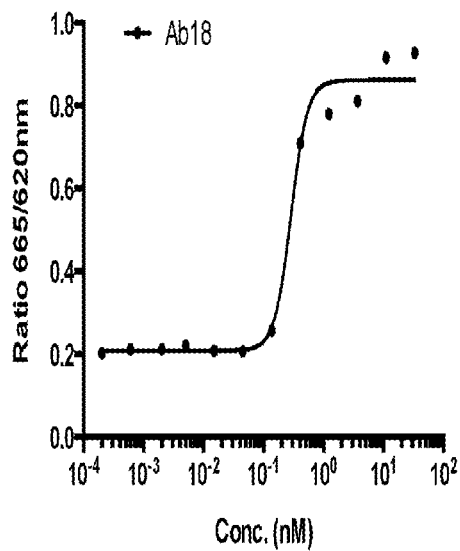
Figure 19S:
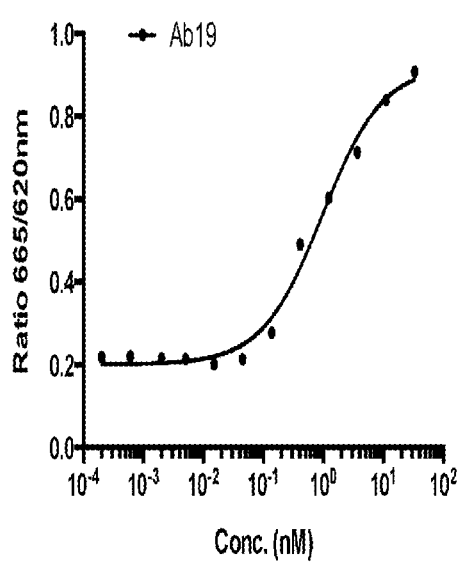
Figure 19T:
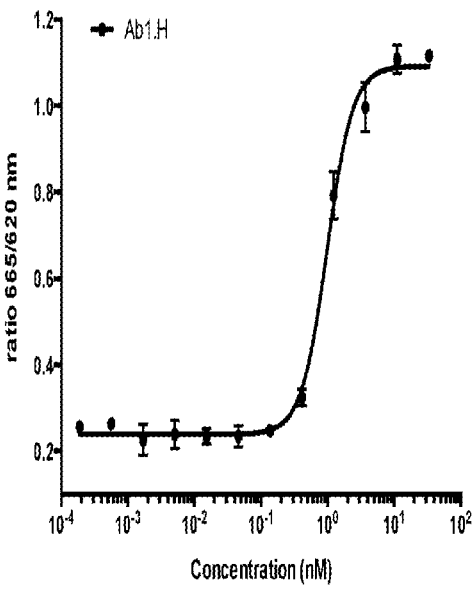
Figure 19U:
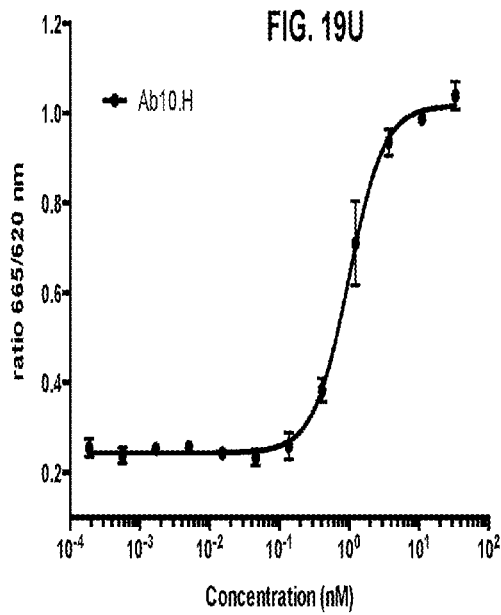
Figure 19V:
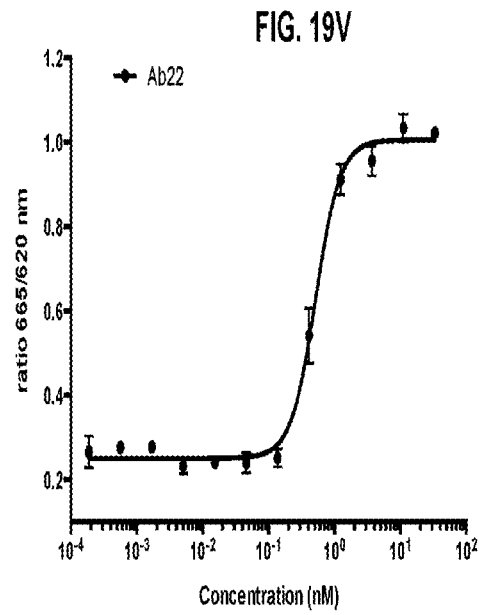
Figure 19W:
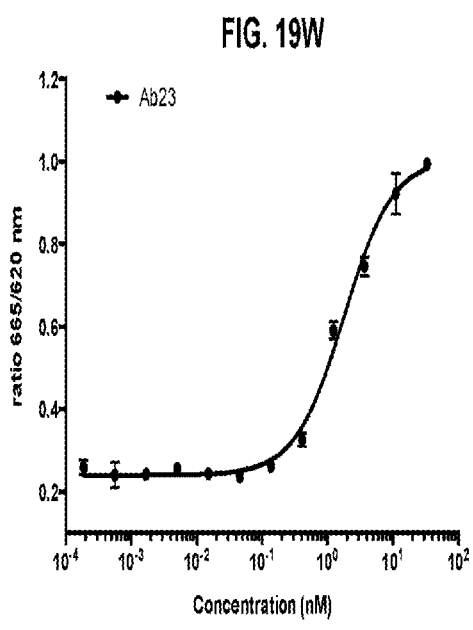
Figure 19X:
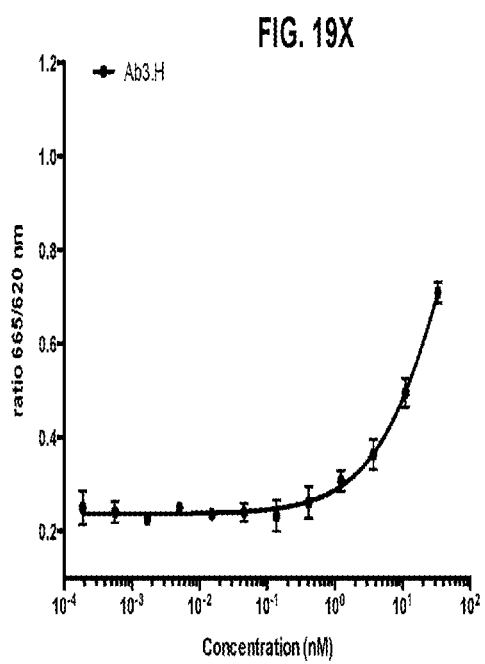
Figure 19Y:
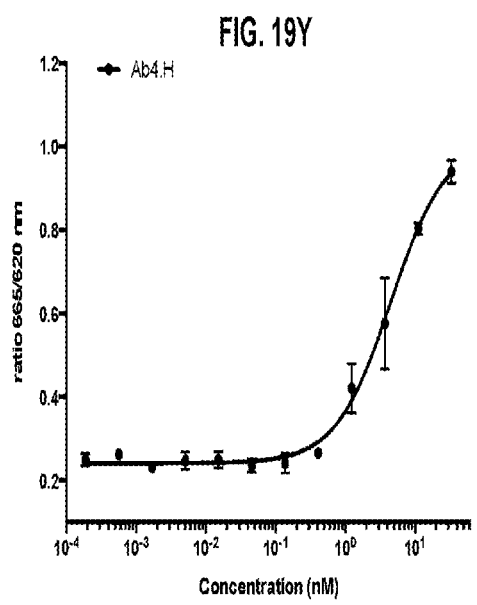
Figure 19Z:
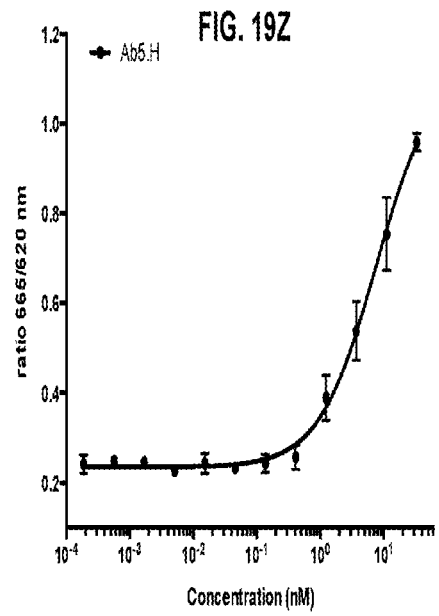
Figure 19A:
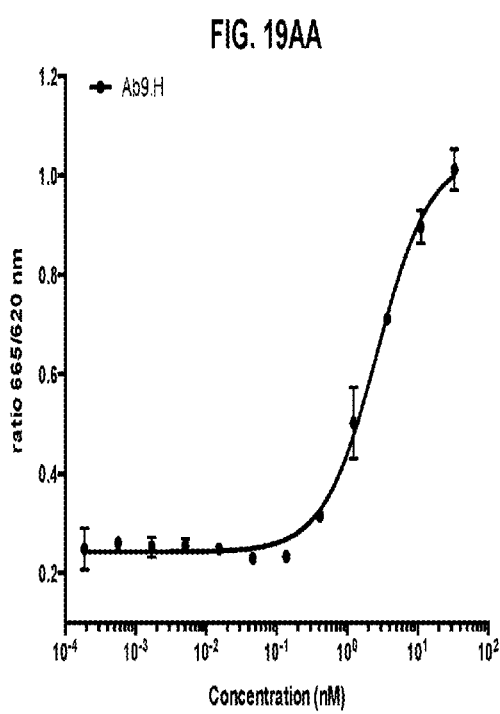
Figure 19B:
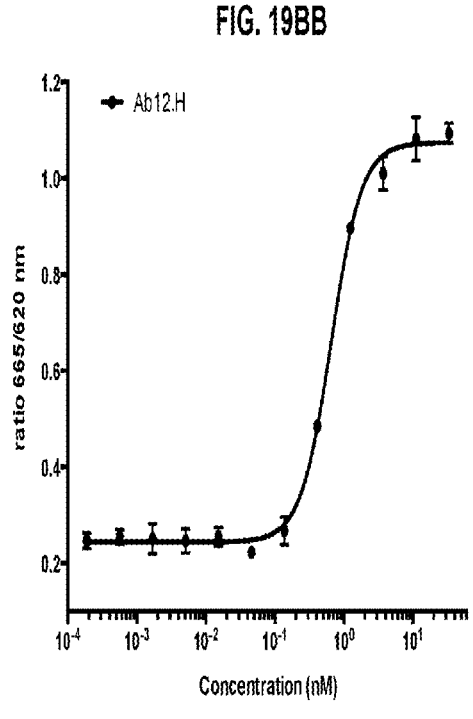

FIGS. 19A-19BB are representative of the inhibition curves obtained by this method (results are shown for Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab1.H, Ab10.H, Ab22, Ab23, Ab3.H, Ab4.H, Ab5.H, Ab9.H, and Ab12.H, respectively). The computed IC$_{50}$ values for each antibody, which are shown below in Table 7, demonstrated that Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab1.H, Ab10.H, Ab22, Ab23, Ab3.H, Ab4.H, Ab5.H, Ab9.H, and Ab12.H inhibited PACAP38-induced cAMP increase in cells expressing human VPAC2-R.

TABLE 7

Inhibition (IC$_{50}$) of PACAP38-induced cAMP increase in cells expressing human VPAC2-R by anti-PACAP antibodies

| ANTIBODY | Inhibition of 1 nM PACAP38-induced human VPAC2-R mediated cAMP increase IC$_{50}$ (pM) |
|---|---|
| Ab1 | 146.7 |
| Ab2 | 174.1 |
| Ab3 | 667.4 |
| Ab4 | 217.9 |
| Ab5 | 239.3 |
| Ab6 | 216.9 |
| Ab7 | 162.4 |
| Ab8 | 146.9 |
| Ab9 | 6965.0 |
| Ab10 | 188.5 |
| Ab11 | 265.2 |
| Ab12 | 179.0 |
| Ab13 | 652.2 |
| Ab14 | 840.4 |
| Ab15 | 22850.0 |
| Ab16 | 1146.0 |
| Ab17 | 205.0 |
| Ab18 | 285.4 |
| Ab19 | 953.5 |
| Ab1.H | 983.0 |
| Ab10.H | 988.0 |
| Ab22 | 515.0 |
| Ab23 | 1789.0 |
| Ab3.H | 64240.0 |
| Ab4.H | 4487.0 |
| Ab5.H | 7466.0 |
| Ab9.H | 2649.0 |
| Ab12.H | 653.0 |

Example 5

Inhibition of PACAP38 Binding to PAC1-R-Expressing Cells

To identify antibodies that block PACAP38 binding to PAC1-R-expressing cells, adherent PC-12 cells (ATCC, Manassas, Va.) expressing PAC1-R were used in a Europium-based PAC1-R expressing cells binding assay.

Antibody solutions were incubated with N-terminal biotinylated PACAP38 at 10× the final concentration (100 nM or 30 nM) for 1 hr, then added to PC-12 cells that were plated 24 hrs. prior in black clear bottom 96 well plates (COSTAR™, Corning Incorporated, Corning, N.Y.) and further incubated for 1 hr at room temperature. After three washes, the cells were incubated with 20 µl Europium-labeled streptavidin (PerkinElmer, Waltham, Mass.) for 1 hr at room temperature. Cells were washed three times, then 20 µl DELFIA® Enhancement solution (PerkinElmer, Waltham, Mass.) was added to each well and incubated for 15 minutes with gentle shaking. Plates were read (Time Resolved Fluorescence ("TRF")) on SPECTRAMAX® (Molecular Devices, Sunnyvale, Calif.) plate reader.

Figure 14A:
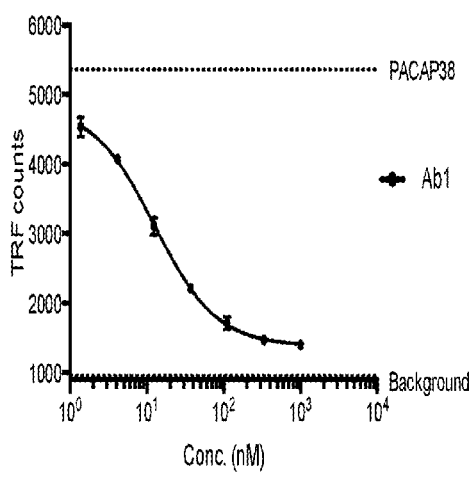
FIGS. 14A-BB provides representative data showing Ab1-mediated (FIG. 14A), Ab2-mediated (FIG. 14B), Ab3-mediated (FIG. 14C), Ab4-mediated (FIG. 14D), Ab5-mediated (FIG. 14E), Ab6-mediated (FIG. 14F), Ab7-mediated (FIG. 14G), Ab8-mediated (FIG. 14H), Ab9-mediated (FIG. 14I), Ab10-mediated (FIG. 14J), Ab11-mediated (FIG. 14K), Ab12-mediated (FIG. 14L), Ab13-mediated (FIG. 14M), Ab14-mediated (FIG. 14N), Ab15-mediated (FIG. 14O), Ab16-mediated (FIG. 14P), Ab17-mediated (FIG. 14Q), Ab18-mediated (FIG. 14R), Ab19-mediated (FIG. 14S), Ab1.H-mediated (FIG. 14T), Ab10.H-mediated (FIG. 14U), Ab22-mediated (FIG. 14V), Ab23-mediated (FIG. 14W), Ab3.H-mediated (FIG. 14X), Ab4.H-mediated (FIG. 14Y), Ab5.H-mediated (FIG. 14Z), Ab9.H-mediated (FIG. 14AA), and Ab12.H-mediated (FIG. 14BB) inhibition of PACAP38 binding to PAC1-R-expressing PC-12 cells obtained following the protocol in Example 5 infra.
Figure 14B:
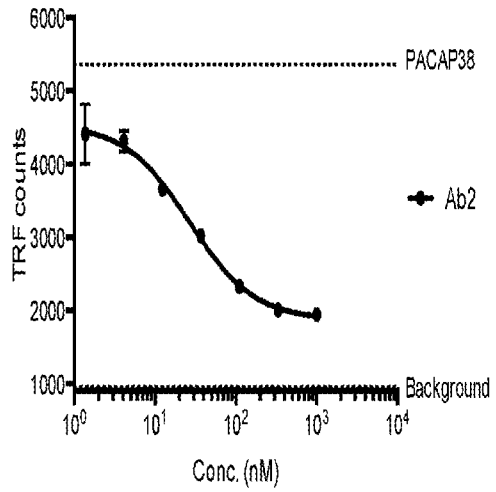
Figure 14C:
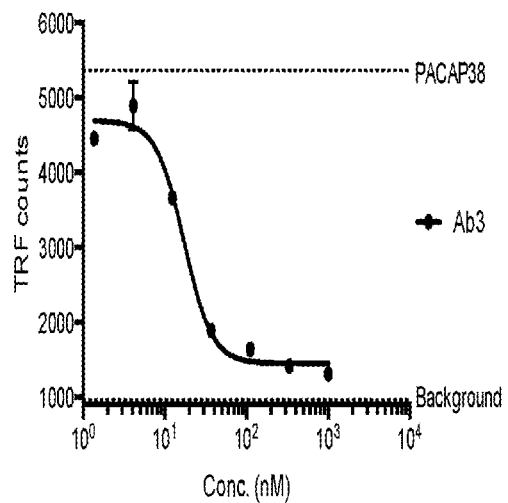
Figure 14D:
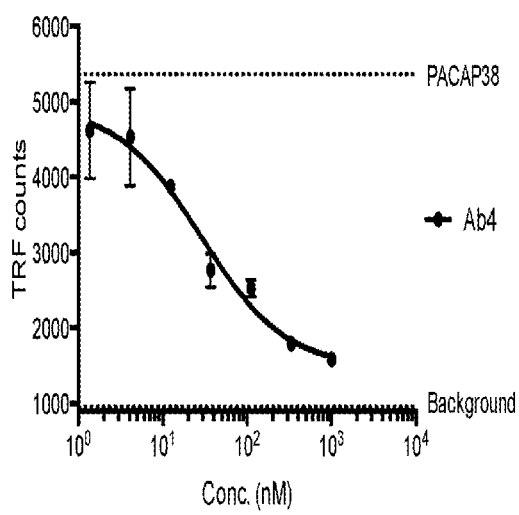
Figure 14E:
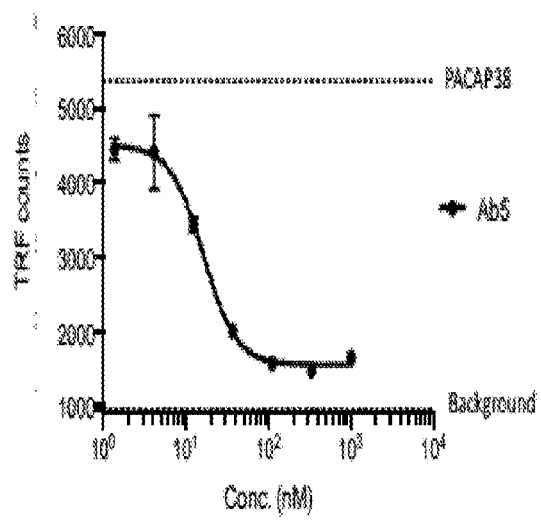
Figure 14F:
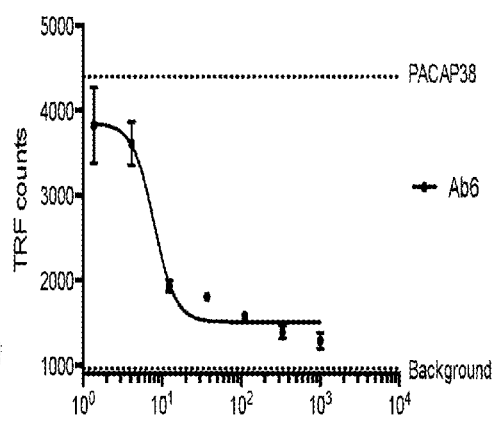
Figure 14G:
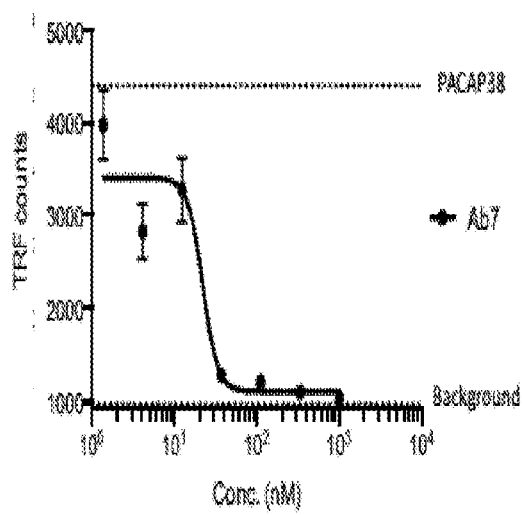
Figure 14H:
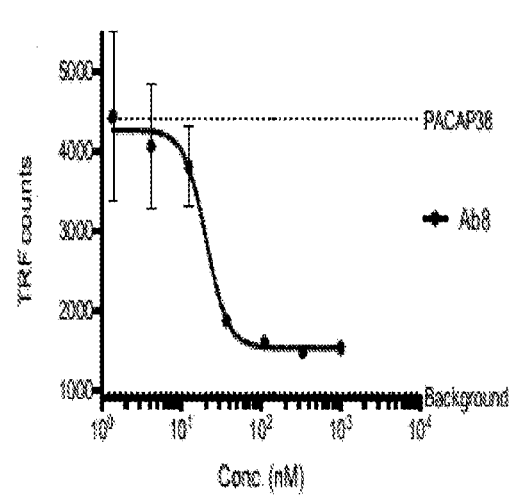
Figure 14I:
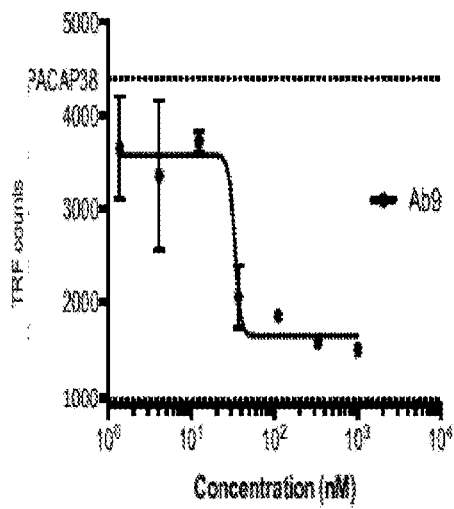
Figure 14J:
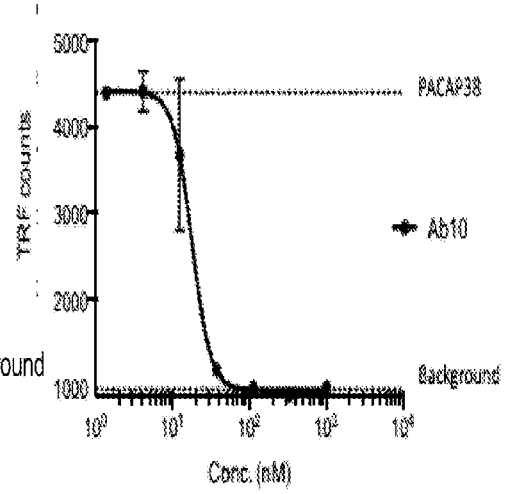
Figure 14K:
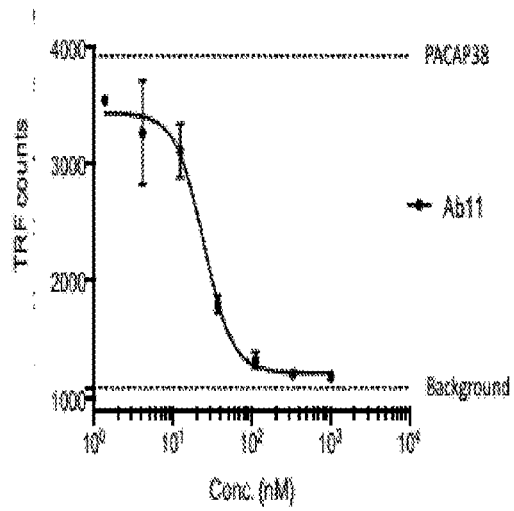
Figure 14L:
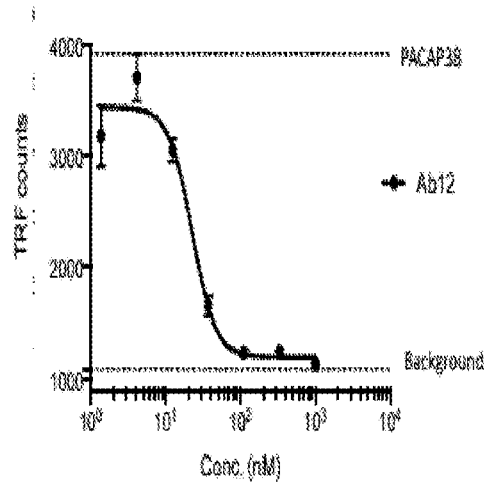
Figure 14M:
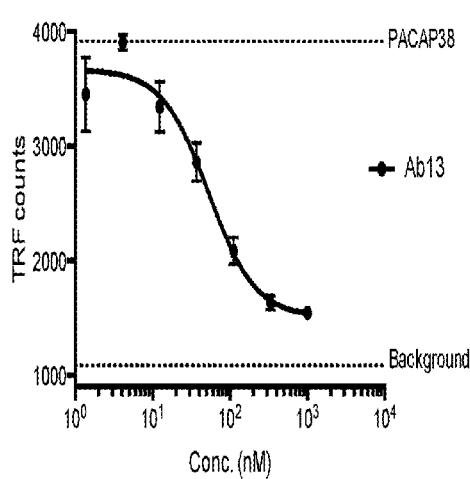
Figure 14N:
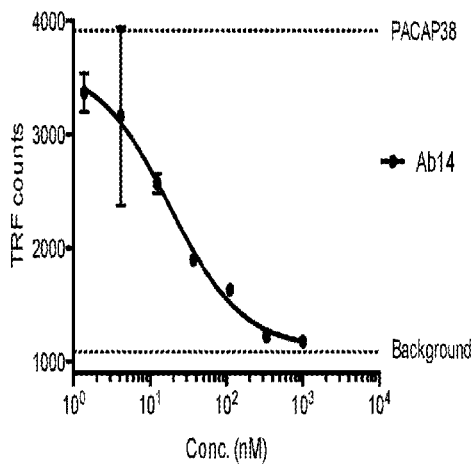
Figure 14O:
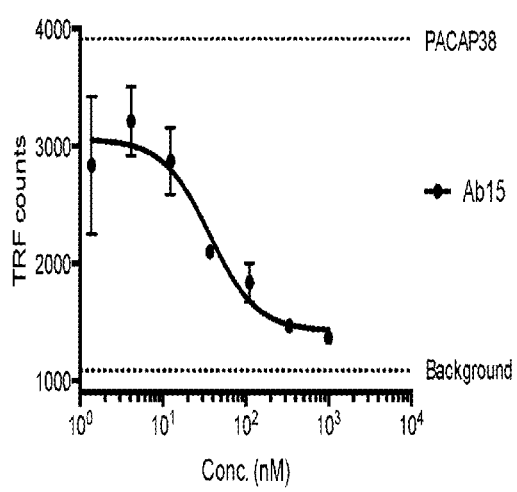
Figure 14P:
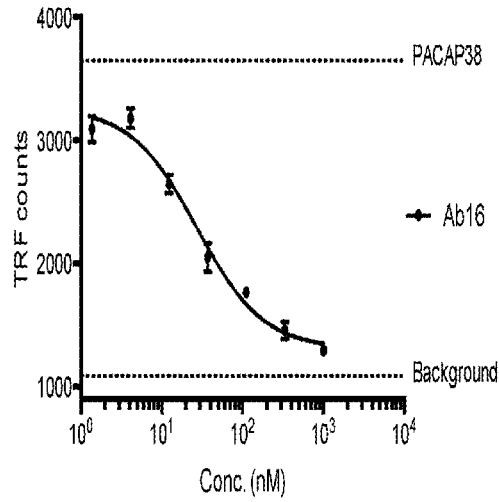
Figure 14Q:
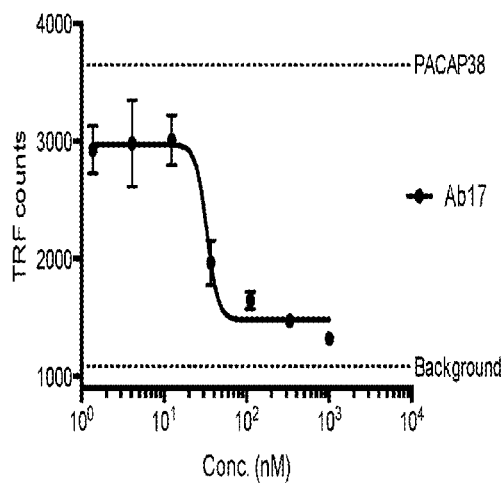
Figure 14R:
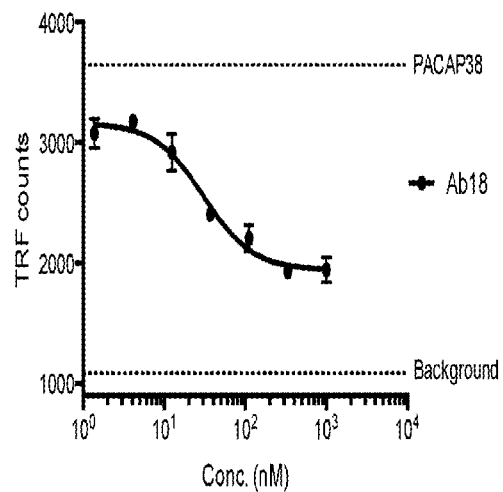
Figure 14S:
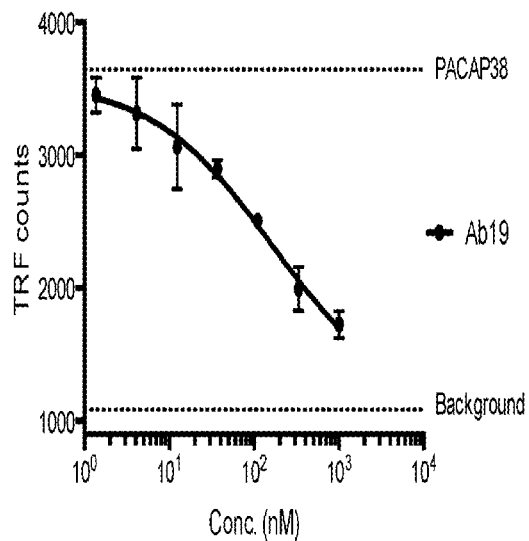
Figure 14T:
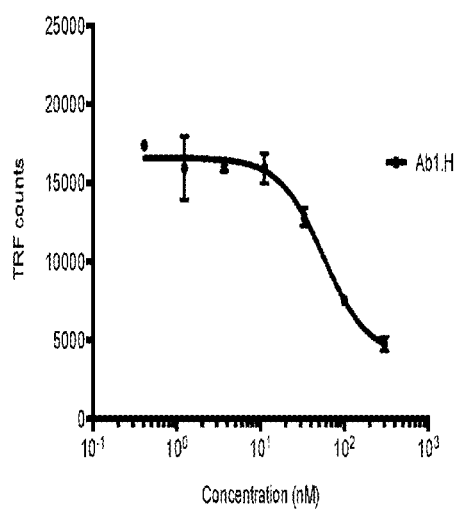
Figure 14U:
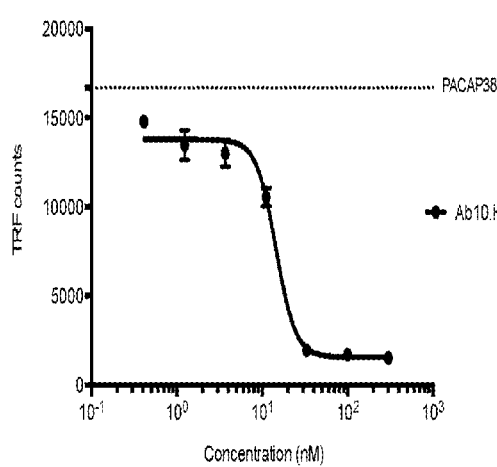
Figure 14V:
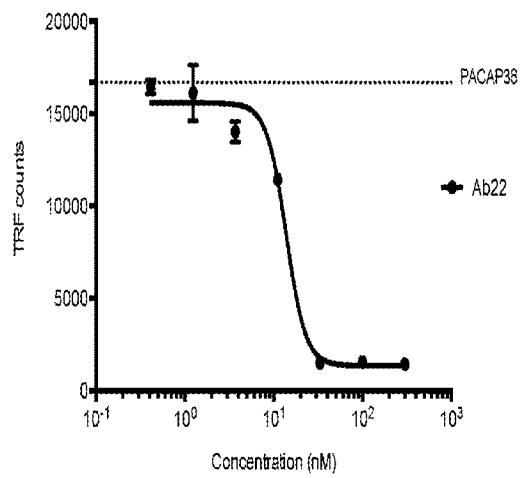
Figure 14W:
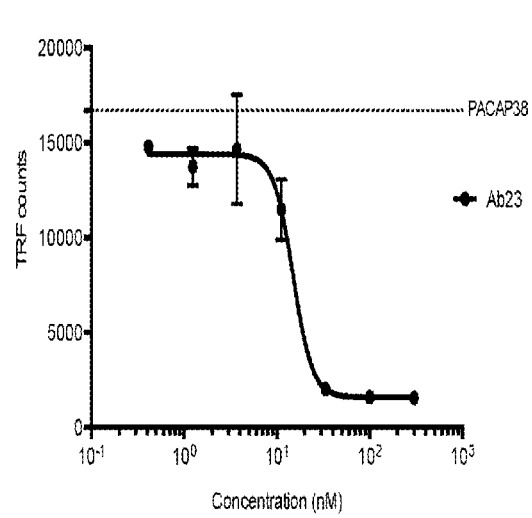
Figure 14X:
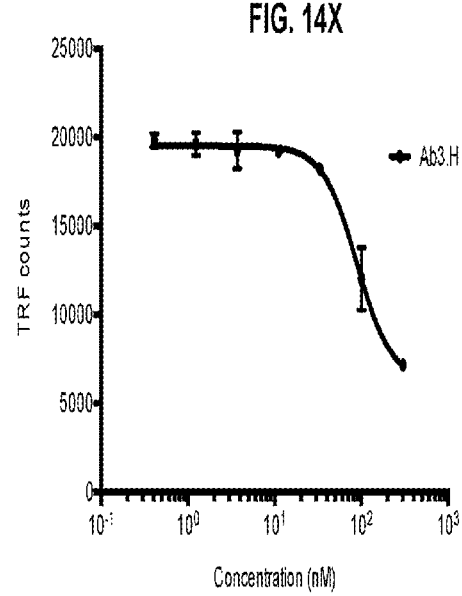
Figure 14Y:
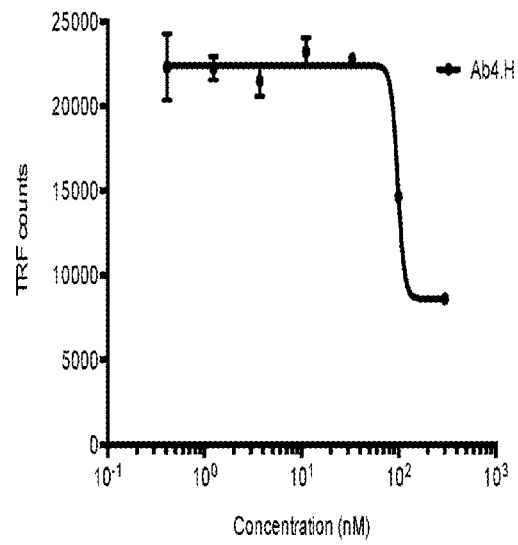
Figure 14Z:
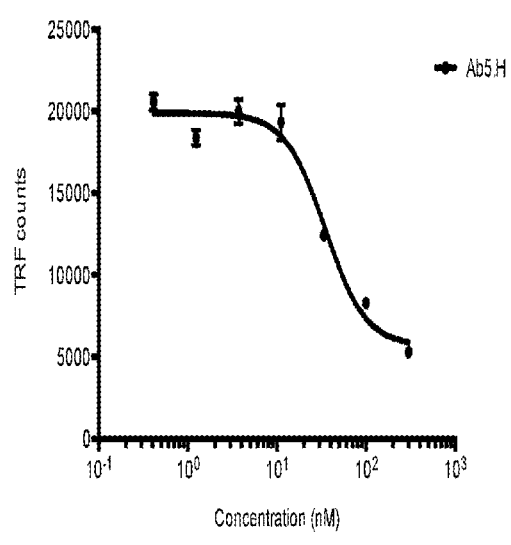
Figure 14A:
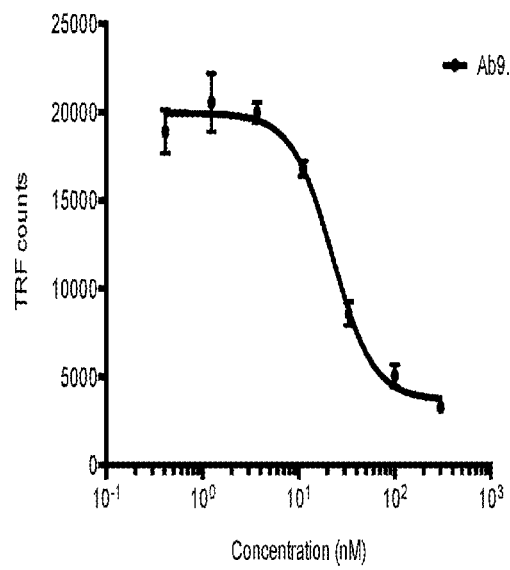
Figure 14B:
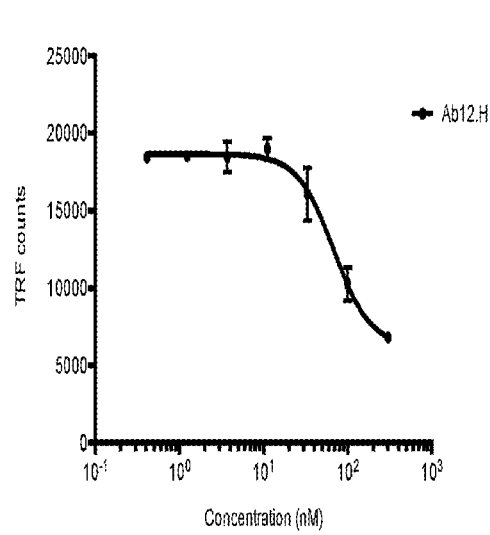
Figure 15A:
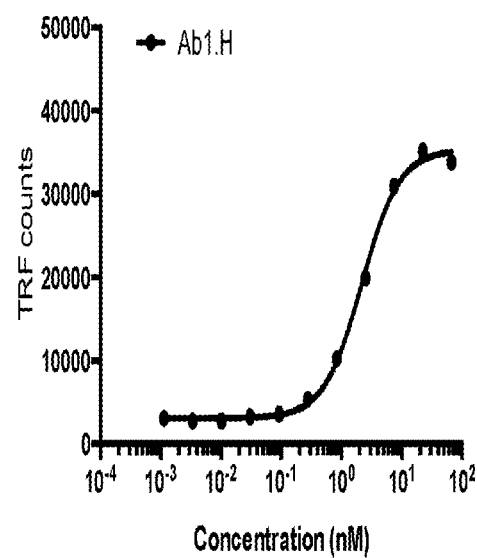
FIGS. 15A-15J provides representative data showing Ab1.H (FIG. 15A), Ab3.H (FIG. 15B), Ab4.H (FIG. 15C), Ab5.H (FIG. 15D), Ab9.H (FIG. 15E), Ab12.H (FIG. 15F), Ab10 (FIG. 15G), Ab10.H (FIG. 15H), Ab22 (FIG. 15I), and Ab23 (FIG. 15J) binding to PAC1-R-expressing PC-12 cells in the presence of PACAP38 obtained following the protocol in Example 6 infra.
Figure 15B:
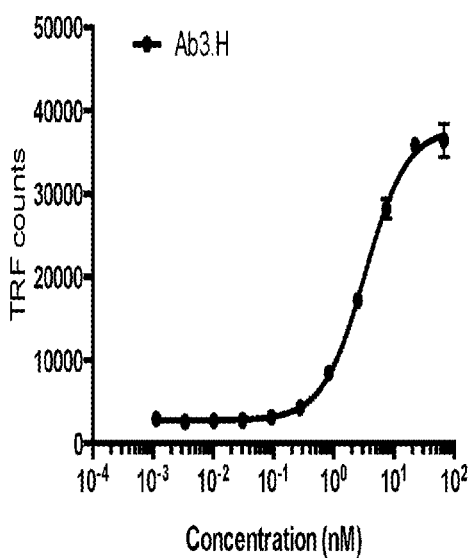
Figure 15C:
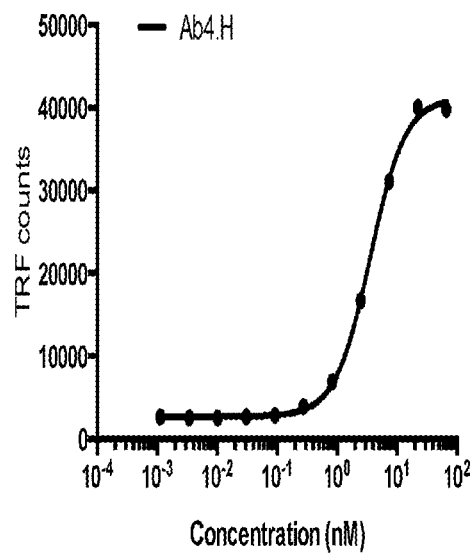
Figure 15D:
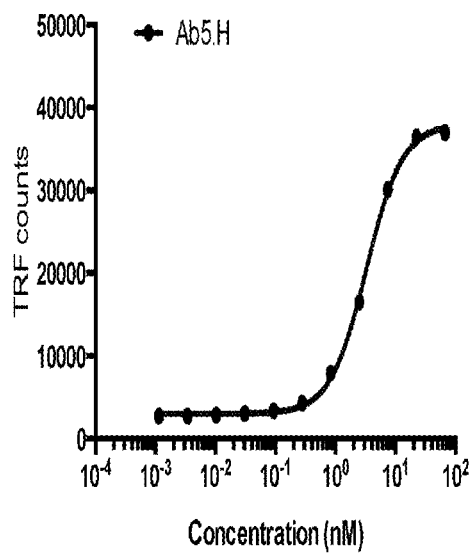
Figure 15E:
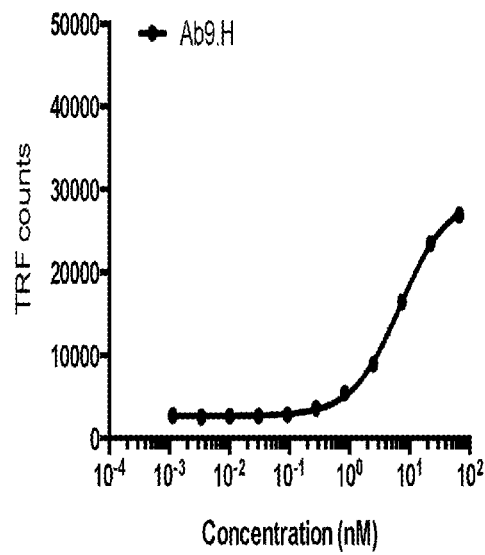
Figure 15F:
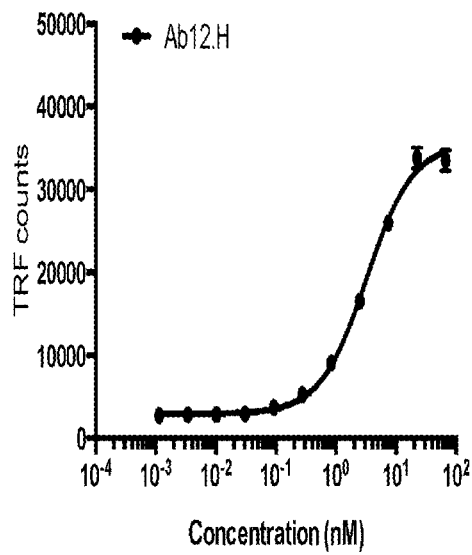
Figure 15G:
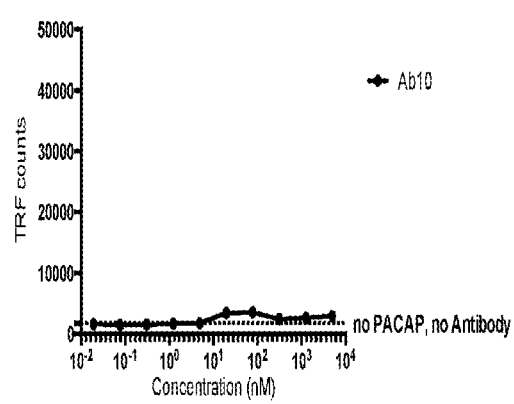
Figure 15H:
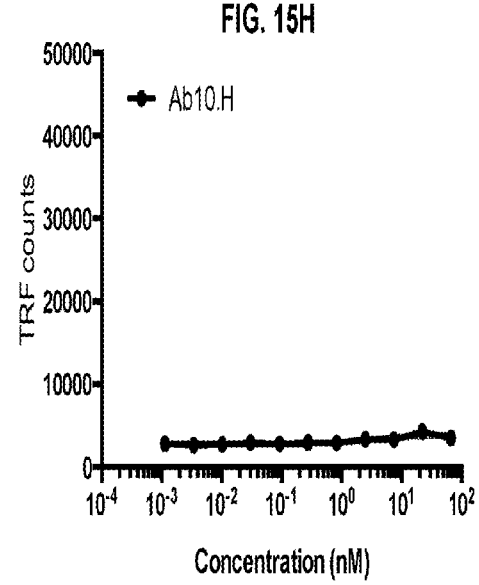
Figure 15I:
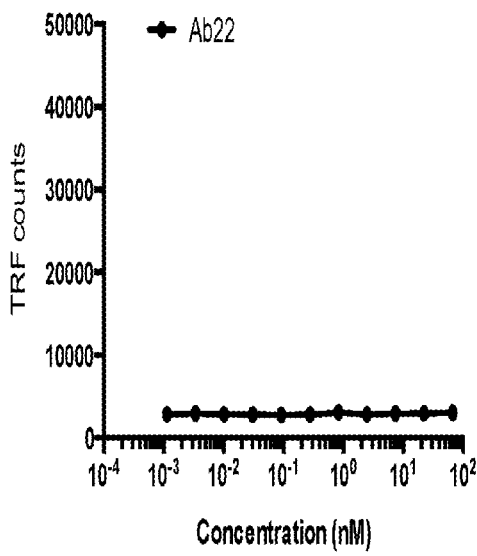
Figure 15J:
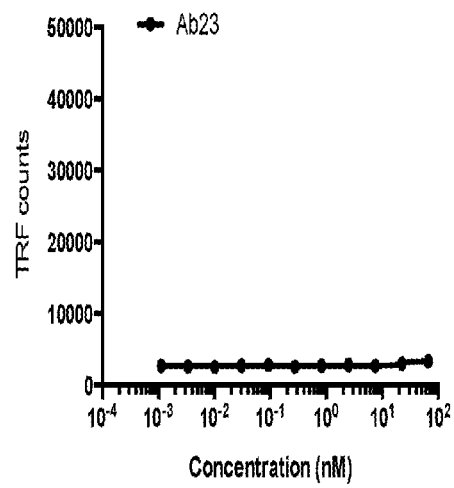

FIGS. 14A-14BB are representative of the inhibition curves obtained by this method (results are shown for Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab1.H, Ab10.H, Ab22, Ab23, Ab3.H, Ab4.H, Ab5.H, Ab9.H, and Ab12.H, respectively) wherein the PAC1-R expressing cells were PC-12 cells. The computed $IC_{50}$ values for each antibody, which are shown below in Table 8, demonstrated that Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab1.H, Ab10.H, Ab22, Ab23, Ab3.H, Ab4.H, Ab5.H, Ab9.H, and Ab12.H inhibited PACAP38 binding to PAC1-R expressing cells.

TABLE 8

Inhibition ($IC_{50}$) of PACAP38 binding to PAC1-R-expressing PC-12 cells by anti-PACAP antibodies.

| ANTIBODY | Inhibition of 100 nM biotinylated PACAP38 binding to PAC1R-expressing PC-12 cells $IC_{50}$ (nM) |
|---|---|
| Ab1 | 12.7 |
| Ab2 | 26.6 |
| Ab3 | 17.2 |
| Ab4 | 28.6 |
| Ab5 | 16.3 |
| Ab6 | 7.8 |
| Ab7 | 22.0 |
| Ab8 | 20.3 |
| Ab9 | 33.3 |
| Ab10 | 17.8 |
| Ab11 | 24.6 |
| Ab12 | 22.6 |
| Ab13 | 53.1 |
| Ab14 | 17.9 |
| Ab15 | 36.7 |
| Ab16 | 27.3 |
| Ab17 | 33.1 |
| Ab18 | 30.6 |
| Ab19 | 162 |

| ANTIBODY | Inhibition of 30 nM Biotinylated PACAP38 binding to PAC1R-expressing PC-12 cells $IC_{50}$ (nM) |
|---|---|
| Ab1.H | 56.3 |
| Ab10.H | 14.5 |
| Ab22 | 13.8 |
| Ab23 | 14.9 |
| Ab3.H | 88.3 |
| Ab4.H | 98.0 |
| Ab5.H | 34.9 |
| Ab9.H | 22.5 |
| Ab12.H | 68.1 |

Example 6

PACAP38-mediated Binding of Anti-PACAP Antibodies to the Cell Surface of PAC1-R Expressing Cells To identify anti-PACAP antibodies that bind, via PACAP38, to the cell surface of PAC1-R expressing cells, adherent PC-12 cells (Japanese Collection of Research Bioresources Cell Bank) expressing PAC1-R were used in a cell surface binding-based assay. To perform the binding experiment, PAC1-R expressing PC-12 cells were first seeded into Corning 96 well white solid bottom plates (Corning, Corning, N.Y.). Cells were initially seeded at $1\times10^5$ cells/well in a solution of complete RPMI ("cRPMI": RPMI medium supplemented with 10% sterile heat-inactivated FBS and 1% sterile antibiotic/antimycotic)+10% FBS, and the plates were allowed to incubate overnight at 37° C. On the day of the binding assay, antibodies at an initial concentration of 15 μg/ml were diluted at a 1:3 ratio in DELFIA® binding buffer (50 mM Tris, 150 mM NaCl, 0.1% azide, 2% horse serum) (Perkin-Elmer, Waltham, Mass.) to a total volume of 60 μL in a separate 96 well round bottom plate. PACAP38 was prepared for the binding assay by diluting it in DELFIA® binding buffer to a concentration of 200 nM, and then 60 μl of the diluted PACAP38 was added to each of the antibody-containing wells to form antibody:antigen complexes. Following addition of PACAP38, the antibody:antigen complexes were incubated at room temperature on a shaker for 1 hour. Separately, the PC-12 cells were prepared for addition of antibody:antigen complexes by washing the cells two times with DELFIA® wash buffer (50 mM Tris, 150 mM NaCl, 0.1% Azide) (Perkin-Elmer, Waltham, Mass.). After washing the cells two times and following the 1 hour room temperature incubation of the antibody:antigen complexes, 50 μl of the antibody:antigen complex was added to each well containing cells. The mixtures of cells and antibody:antigen complexes were then incubated for 30 minutes at room temperature. Following this 30 minute incubation, each mixture was washed two times with DELFIA® wash buffer (Perkin-Elmer, Waltham, Mass.).

DELFIA® Europium labeled anti-human IgG detection reagent (Cat #1244-330, Perkin-Elmer, Waltham, Mass.) was diluted to a concentration of 300 ng/ml in DELFIA® Binding Buffer. Following dilution, 50 μl of the anti-human IgG detection reagent was added to each well containing cells, and a 30 minute incubation at room temperature followed this addition of IgG detection reagent. After completion of the 30 minute room temperature incubation, the cells were then washed two times with DELFIA® wash buffer. Next, 50 μl of DELFIA® Enhancement Solution (Cat #1244-105, Perkin-Elmer, Waltham, Mass.) was added to each well containing cells for a final 15 minute room temperature incubation with shaking. The plates were then read (TRF, excitation 330 nm, emission 620 nm) on a SPECTRAMAX® (Molecular Devices, Sunnyvale, Calif.) plate reader.

FIGS. 15A-15J are representative of the binding curves obtained by this method (results are shown for Ab1.H, Ab3.H, Ab4.H, Ab5.H, Ab9.H, Ab12.H, Ab10, Ab10.H, Ab22, and Ab23, respectively) wherein the PAC1-R expressing cells were PC-12 cells. Ab1.H, Ab3.H, Ab4.H, Ab5.H, Ab9.H, and Ab12.H demonstrated binding to the surface of PAC1-R expressing cells in the presence of PACAP38, while Ab10, Ab10.H, Ab22, and Ab23 did not appear to appreciably bind to the surface of PAC1-R expressing cells using this assay. The binding of Ab1.H, Ab3.H, Ab4.H, Ab5.H, Ab9.H, and Ab12.H to the cell surface of PAC1-R cells was only observed in the presence of PACAP38. Without intent to be bound by theory, it is hypothesized that the binding of the antibodies to the cell surface was mediated by binding of PACAP38 to GAGs that were present on the cell surface, since binding of PACAP38 by GAGs has been previously demonstrated as a PAC1-R receptor independent mechanism of PACAP38 binding and internalization by PC-12 cells (see Doan et al. (2012), Juhász et al. (2014), and Neree et al. (2015)).

Example 7

Inhibition of PACAP38-induced Dermal Vasodilation in Rabbits by Anti-PACAP Antibody Ab1.H Intradermal injection of PACAP38 has been shown to elicit a localized vasodilation in rabbits and humans (Warren et al., *J. Cardio. Pharmacol.*, 29(1): 83-87 (1992); Seelinger et al., *Am. J. Path.*, 177(5):2563-2575 (2010)). An in vivo efficacy study was conducted to determine the activity of Ab1.H to inhibit a localized dermal vasodilation induced by an intradermal injection of PACAP38 in male New Zealand White rabbits.

Groups of 4 rabbits were dosed with either 90 mg/kg of Ab1.H or with negative control vehicle (25 mM histidine, 250 mM sorbitol, pH 6.0). Injections were performed by IV (ear vein) bolus administration on day 0. Prior to each rabbit PACAP38 challenge, the scapular region of each animal was clipped free of hair and wiped with 20% (v/v) alcohol in water. On day 2, the animals were pre-anesthetized with ketamine hydrochloride and maintained under deep anesthesia with isoflurane gas. Four sites (Region of Interest ("ROI")) for injection were identified on the back of each animal using a SHARPIE® permanent marker. Dermal vasodilation and blood perfusion were monitored using the PeriCam PSI NR system for Laser Speckle Contrast Analysis ("LASCA") imaging (Perimed, Järfälla, Sweden), before (baseline) and for 35 minutes after intradermal PACAP38 challenge. Intradermal PACAP38 challenge was performed as follows: each animal received single intradermal administrations (100 μl/site) of vehicle (one site or ROI) and PACAP38 at 30 pmoles/site (3 sites or 3 ROIs). The blood perfusion rates for each ROI were reported by the PeriCam PSI NR system in Perfusion units ("PU") and analyzed using PIMSoft (Ver. 1.5 (Perimed, Järfälla, Sweden)).

For each treatment group, the relative % PU change following Ab1.H or negative control administration compared to baseline was calculated for each ROI (% PU change for each PACAP38 challenge site–% PU change for the vehicle site). The relative % PU change in the Ab1.H group was compared to the relative % PU change in the Negative control group by performing a two-tailed unpaired t-test statistical evaluation using GraphPad Prism (version 5.0d, GraphPad Software, La Jolla, Calif.) software.

FIG. 20 demonstrates that Ab1.H inhibited PACAP38-induced dermal vasodilation in rabbits, indicating effectiveness of the antibody at neutralizing PACAP38 activity in vivo.

Example 8

Inhibition of PACAP38-induced Dermal Vasodilation in Rabbits by Anti-PACAP Antibody Ab10

Intradermal injection of PACAP38 has been shown to elicit a localized vasodilation in rabbits and humans (Warren et al. (1992); Seelinger et al. (2010)). An in vivo efficacy study was conducted to determine the activity of Ab10 to inhibit a localized dermal vasodilation induced by an intradermal injection of PACAP38 in male New Zealand White rabbits.

Groups of 4 rabbits were dosed with either 72 mg/kg of Ab10 or with isotype antibody control. Injections were by (ear vein) bolus intravenous administration on day 0. Prior to each rabbit PACAP38 challenge, the scapular region of each animal was clipped free of hair and wiped with 20% (v/v) alcohol in water. On day 2, the animals were pre-anesthetized with ketamine hydrochloride and maintained under deep anesthesia with isoflurane gas. Four sites (ROIs) for injection were identified on the back of each animal using a SHARPIE® permanent marker. Dermal vasodilation and blood perfusion were monitored using the PeriCam PSI NR system for LASCA imaging (Perimed, Järfälla, Sweden), before (baseline) and for 35 minutes after intradermal PACAP38 challenge. Intradermal PACAP38 challenge was performed as follows: each animal received single intradermal administrations (100 μl/site) of vehicle (one site or ROI) and PACAP38 at 30 pmoles/site (3 sites or 3 ROIs). The blood perfusion rates for each ROI were reported by the PeriCam PSI NR system in PU and analyzed using PIMSoft (Ver. 1.5 (Perimed, Järfälla, Sweden)).

For each treatment group, the relative % PU change following Ab10 or Isotype Ab control administration compared to baseline was calculated for each ROI (% PU change for each PACAP38 challenge site–% PU change for the vehicle site). The relative % PU change in the Ab10 group was compared to the relative % PU change in the Isotype Ab control group by performing a two-tailed unpaired t-test statistical evaluation using GraphPad Prism (version 5.0d, GraphPad Software, La Jolla, Calif.) software.

FIG. 21 demonstrates that Ab10 inhibited PACAP38-induced dermal vasodilation in rabbits, indicating effectiveness of the antibody at neutralizing PACAP38 activity in vivo.

Example 9

Epitope Binning of Anti-PACAP Antibodies, Ab1 and Ab10

Ab1 was biotinylated at a 10:1 molar ratio with biotin (Thermo Fisher Scientific, Waltham, Mass.) per manufacturer guidelines. A 5 step biolayer interferometry experiment was performed as follows: In step 1, streptavidin biosensors (Pall ForteBio LLC, Menlo Park, Calif.) were equilibrated for 50 seconds in 1× kinetics buffer (a 1:10 dilution in DBS of Pall ForteBio LLC, Menlo Park, Calif., cat #18-5032). In step 2, a 2 μg/ml dilution of biotinylated antibody Ab1 in 1× kinetics buffer was immobilized for 500 seconds onto Streptavidin biosensors. In step 3, the antibody-functionalized biosensors were incubated in a solution of 2 μM unlabeled PACAP peptide (American Peptide Company, Sunnyvale, Calif., catalog #34-0-20) in 1× kinetics buffer for 200 seconds. In step 4, the sensors were placed into 67 nM solutions of either unlabeled antibody Ab10 (FIG. 22A) or unlabeled antibody Ab1 as control (FIG. 22B) in 1× kinetics buffer for a 1000 second association step. Stability of binding was monitored during step 5 for a 1000 second dissociation in 1× kinetics buffer. In FIG. 22A, the "sandwich-style" capture of Ab10 via Ab1-captured PACAP indicates simultaneous and non-competitive binding of these two antibodies to PACAP. The control experiment in FIG. 22B shows minimal "sandwich-style" capture of Ab1 via Ab1-captured PACAP. The experiment was conducted on a ForteBio OCTET® QK instrument (Pall ForteBio LLC, Menlo Park, Calif.) at 30° C. and 1000 RPM.

Example 10

Inhibition of PACAP27 Binding to Human PAC1-R by Anti-PA CAP Antibodies

To identify antibodies that block PACAP27 binding to PAC1-R, antibodies at an initial concentration of 30 nM were diluted in incubation buffer (50 mM Hepes pH 7.4, 1 mM $CaCl_2$, 5 mM $MgCl_2$, 0.2% BSA) and serial 1:3 dilutions were performed. Antibody dilutions (30 nM, 10 nM, 3 nM, 1 nM, 0.3 nM, 0.1 nM, 0.03 nM, 0.01 nM, 0.003 nM and 0.001 nM) were then mixed and pre-incubated at 25° C. for 30 minutes with 0.1 nM of $^{125}$I-labelled PACAP27 in incubation buffer. The antibody: $^{125}$I-labelled PACAP27 mixture was then added to 0.5 µg aliquots of cell membranes derived from Chem-1 cells expressing human recombinant PAC1-R long isoform in incubation buffer. The mixture was then incubated for 1 hour at 25° C. Following incubation, the samples were filtered and washed. Afterward, the filters were counted to quantitate $^{125}$I-labelled PACAP27. As an experimental control, non-specific binding to the cell membranes was estimated using 0.1 µM of labeled PACAP27. The results indicated that Ab1.H, Ab10.H, and Ab12.H were capable of blocking PACAP27 binding to PAC1-R, thereby demonstrating inhibition of ligand-receptor binding by the tested antibodies presented in Table 9.

TABLE 9

Inhibition ($IC_{50}$) of 0.1 nM $^{125}$I-PACAP27 binding to PAC1-R by anti-PACAP antibodies

| ANTIBODY | $IC_{50}$ (nM) |
|---|---|
| Ab1.H | 0.70 |
| Ab10.H | 0.22 |
| Ab12.H | 0.16 |

Example 11

Effect of Anti-PACAP Antibody on Light Aversion

To examine the effect of anti-PACAP antibodies on photophobia, a mouse model was employed in which mice were administered PACAP to trigger photophobia. Photophobia was detected using a light aversion assay using a light-dark box as described in Kaiser et al., *J. Neurosci.*, 32(44):15439-15449, 2012. Mice were then administered anti-PACAP antibodies Ab1.H or Ab10.H or an unrelated control antibody and their aversion to light quantitated. Results are reflected in FIGS. 23-25.

Light Aversion Assay

As described in Kaiser et al., the testing chambers were a plexiglass open field (27 cm wide×27 cm deep×20.3 cm high) containing three sets of 16 beam infrared arrays (two sets of perpendicular beams cross at a height of 1.0 cm to detect mouse location and locomotion, and the third beam crosses the width of the chamber at a height of 7.3 cm to detect vertical activity). The field was divided in two equal sized zones by a dark insert, which is a five-sided, black-colored plexiglass box with a top, but no floor. The use of infrared light beams allowed tracking in both zones. An opening (5.2 cm×6.8 cm) in the dark insert allowed free movement between zones. While the dark insert blocked direct light, some light could still enter through the opening. Each testing chamber was located inside a sound-attenuating cubicle (56 cm wide×38 cm deep×36 cm high) with a fan for ventilation (Med Associates, Inc.®, St. Albans, Vt.). A computer using Activity Monitor v6.02 (Med Associated Inc.) was used for recording data from the six chambers.

For each chamber, a LED panel was attached to the ceiling of the sound-attenuating cubicle. The LED panel contains 36 collimated 1 watt LEDs (5500 k Daylight White) (LEDwholesalers.com, Burlingame, Calif.). To control light intensity, each LED panel was connected to a dimmable LED driver (LINEARdrive®; eldoLED America Inc., San Jose, Calif.) leading to a potential range of light intensity from $3.0 \times 10^2$ to $2.7 \times 10^4$ 1x. Levels were further attenuated to $5.5 \times 10^1$ 1x using wax paper placed on a clear plexiglass tray below the LEDs. Light intensity was measured with Traceable Dual-Display Light Meter (Control Company, Friendswood, Tex.) placed on the floor of the testing chamber. At $2.7 \times 10^4$ 1x, LED lights generated some heat in the sound attenuating chamber with the dark zone at ~25° C. and light zone at ~27° C.

On the day of the experiment, mice were transported from animal housing and allowed to acclimate to the testing room (~22° C.) for at least 30 to 60 minutes with standard overhead fluorescent lighting (~200 1x inside the housing cage). Room lights remained on, unless noted otherwise. In addition, all sound-generating equipment were turned on during acclimation and remained on until testing was complete. There was minimal human presence in the room during acclimation. Behavioral testing was performed between 0800 CST and 1400 CST. Any abnormal physical conditions (e.g. missing eye) were noted.

Ten week old male and female CD1 mice were used in the study (strain #022, Charles River, Wilmington, Mass., US). Mice were allowed to recover from shipping for one to two weeks prior to testing.

Acclimation

All mice were acclimated in the testing room at least 30 to 60 minutes prior to being placed in the light/dark chamber. The light intensity in the chamber was initially set to $2.7 \times 10^3$ 1x. The mice were tested for thirty minutes in the chamber every day they were exposed to the light/dark chamber. Baseline time in light for each mouse was obtained by exposing the mice to the light/dark chamber twice, with a period of rest of three days between baseline measurements (FIGS. 23 and 25, "Baseline1" and "Baseline2," or "Baseline", respectively).

Treatment

The mice were administered 30 mg/kg of either anti-PACAP antibody or control IgG antibody (negative control antibody having the same framework as the tested antibodies and that recognizes digoxigenin) by i.p. injection. The mice were then returned to their home cage to rest for one day (24 hours) prior to testing. The mice were then administered 0.6 mg/kg PACAP or vehicle by i.p. injection and rested for 30 minutes. The mice were then placed in the light/dark chamber for 30 minutes (FIG. 23 and FIG. 25, "Treatment"). After each mouse was exposed to the light/dark chamber, the light/dark chamber and components were cleaned with germicidal wipes and dried. About 5 to 7 minutes after a mouse was placed in the light/dark chamber, the next mouse to be tested was injected with PACAP or vehicle, as described above. This interval was approximately the amount of time required to clean the light/dark chamber between experiments.

Motility Measurements

Motility was measured at 5 minute intervals over the 30 minute testing period as described in Kaiser et al., *J. Neurosci.*, 2012. Briefly, the number of vertical movements, such as rearing, ambulatory distance (cm, the total distance traveled during ambulatory movement status), transitions, and resting (percentage of time spent breaking no new beams), were measured by light beam. All motility parameters were normalized to the time spent in each zone to account for different amount of time spent in that zone; thus, the raw value for each parameter was divided by the time spent in that zone during the 5 min interval. Time spent in each chamber was analyzed using GraphPad Prism software (GraphPad Software, San Diego, Calif.), and reported as mean±standard error of the mean ("SEM"). Comparison was calculated by two-way repeated measure ANOVA, with Bonferroni's multiple-comparison test for post-hoc analysis.

Mice were excluded based on three criteria: (1) after the first two exposures to the box the baseline time in light was analyzed and any mouse that spent +/− one standard deviation of mean time in light at baseline was removed from the experiment and not given drug treatment, (2) mice were excluded from analysis if they were identified as statistical outliers (box plot, 10-90%), and (3) mice were excluded if they moved less than 10% of the time (combined light and dark).

In two experiments comparing the response of mice administered either antibody Ab1.H or Ab10.H to control IgG, the results indicate that mice administered either PACAP antibody Ab1.H or Ab10.H spent more time in light as compared to IgG control mice. FIG. 23 shows that mice behaved normally and similarly in both baseline measurements. On the other hand, the data provided in FIG. 23 show that mice treated with control IgG antibody and then PACAP spent statistically less time in light (squares) than mice administered anti-PACAP antibody Ab1.H and then PACAP (circles). (See, FIG. 23, "Treatment"). The data provided in FIG. 25 also show that mice behaved normally and similarly in baseline measurements. On the other hand, the data provided in FIG. 25 show that mice treated with control IgG antibody and then PACAP spent statistically less time in light (triangles) than mice administered anti-PACAP antibody Ab10.H and then PACAP (inverted triangles). (See, FIG. 25, "Treatment"). Time between each measurement was three days. The mean±SEM is provided for each 5-minute interval. Mice administered vehicle only behaved as normal controls. Data provided in FIG. 24 shows that administration of either anti-PACAP antibody Ab1.H, or control IgG, and vehicle ("Veh+PAC Ab" and "Veh+Con Ab," respectively) did not markedly alter mouse behavior. FIG. 24 also shows that the average time of the mouse in light decreased when PACAP and control IgG were administered ("PACAP+Con Ab"), whereas mice administered anti-PACAP antibody Ab1.H and PACAP exhibited normal, non-light-sensitive behavior ("PACAP+PAC Ab").

Example 12

Epitope Mapping of Anti-PACAP Antibodies

In order to determine the epitopes contained within PACAP to which the anti-PACAP antibodies and antigen binding fragments thereof of the invention bind, alanine scanning experiments were used. To perform these experiments, PACAP peptides were synthesized with a single point mutation in each position replacing the native amino acid with an Alanine ("Ala"), and the consequences of a single point mutation as it relates to binding affinity of PACAP and an antibody were measured.

Since an alanine residue already occupies positions 18, 24, and 25 of wild-type PACAP, according to convention, these Ala residues were replaced with Valine ("Val") to determine the possible effects of the removal of the alanine at these positions on the binding of the subject anti-PACAP antibodies to PACAP. Per the usual convention these Ala mutants were labeled according to the position in PACAP 1-38 followed by the letter code for the substituted amino acid, e.g., 10A indicates PACAP 1-38 substituted with alanine at amino acid position 10. Binding of monoclonal antibodies for human PACAP and each mutant peptide was detected using SPR on the PROTEON™ XRP36 (Bio-Rad Laboratories, Hercules, Calif.). Samples and sample controls were immobilized onto a PROTEON™ GLC sensor chip (Bio-Rad Laboratories, Hercules, Calif.) at a single density using standard amine coupling. The running buffer used for immobilization was DPBS/modified (HYCLONE™, GE Healthcare Life Sciences, Marlborough, Mass.) and immobilization was conducted at 25° C. The PROTEON™ GLC sensor chip (Bio-Rad Laboratories, Hercules, Calif.) was initialized and pre-conditioned per the manufacturer's protocol (bi-directional injections of 0.5% SDS, 50 mM NaOH, 100 mM HCl).

The immobilization process was performed step-wise to ensure a unique antibody on the spots of the PROTEON™ Chip (Bio-Rad Laboratories, Hercules, Calif.). The surface of the chip was activated with a 1:1 mixture of 1-ethyl-3-(3-dimethylaminopropyl)carbodiimide/N-hydroxysuccinimide ("EDAC/NHS") and flow rate of 30 μL/min×5 minutes. Antibody samples were previously dialyzed or exchanged to 10 mM HEPES 150 mM NaCl pH 7.2, and the antibody concentration was quantified using a NANODROP™2000 spectrophotometer (Thermo Fisher Scientific, Waltham, Mass.). The immobilization targeted 2000-3000 response units ("RU"). Antibody samples (5 μg/ml) in 10 mM sodium acetate, pH 5.5, were flowed at 30 μL/min×4 minutes. Deactivation was achieved at a flow rate of 30 μL/min for 5 minutes using 0.3 M ethanolamine concomitantly with the next activation.

Following immobilization, the running buffer was changed to 1×PBST (4.3 mM sodium phosphate, 1.4 mM potassium phosphate, 135 mM NaCl, 2.7 mM KCl, 0.05% TWEEN®) with 0.2 M arginine HCl (to reduce non-specific binding), BSA (0.2 mg/ml, as a carrier) and PROCLIN300® (0.005%, as a preservative, Sigma Aldrich, St. Louis, Mo.) and the chip surface was allowed to re-equilibrate with an injection of new running buffer. Stock solutions of human PACAP peptide (1-38) and alanine/valine mutant peptides (Molecular Weight(s): 4.5 kD) at a concentration of 1 mg/ml were added to the running buffer to final concentrations of 0.45 μg/ml (100 nM). These mixtures were then used to query individual spots on the chip surface with flow rates of 100 μL/min×2 minutes and allowed to dissociate for 600 seconds. Chip surfaces were regenerated between analytes by the addition of 0.85% phosphoric acid.

Each of antibodies Ab1, Ab2, Ab13, Ab14, Ab15, Ab16, Ab17, Ab18, Ab19, Ab5, Ab7, Ab11, Ab12, Ab4, Ab3, Ab6, Ab8, Ab9, Ab22, and Ab23 were examined under the same conditions as herein described Sensorgrams representing affinity data of mutant peptide binding to a panel of antibodies were assessed using multiple parameters. A visual inspection was first performed for each sensorgram to assess apparent maximal response ("Rmax") relative to the wild-type PACAP peptide (1-38). Second, a visual inspection of the dissociation phase was performed with an emphasis on the curve shape relative to the wild-type PACAP peptide. Off-rates (dissociation rates) were calculated for wild-type PACAP peptide and the binding of each mutant peptide to the panel of antibodies. Finally, as a control experiment to confirm the integrity of each peptide variant (wild-type or mutant), the binding affinity of each member of the peptide library was individually determined for each member of a panel of antibodies that were known to bind wild-type PACAP, to ensure that each Ala mutant PACAP peptide exhibited binding affinity that was similar to the binding affinity of wild-type PACAP peptide. Collective assessment of all described parameters identified PACAP amino acid residues important for PACAP/antibody binding.

Binding and dissociation data are shown in FIGS. 26A-45B for binding of antibodies Ab1, Ab2, Ab13, Ab14, Ab15, Ab16, Ab17, Ab18, Ab19, Ab5, Ab7, Ab11, Ab12, Ab4, Ab3, Ab6, Ab8, Ab9, Ab22, and Ab23 to wild-type PACAP and PACAP mutants. The upper panel in each figure contains the binding data for residues in PACAP that appeared to be important for antibody binding (labeled at the right end of the graph, e.g., "10A" indicates the binding data for the mutant containing alanine at position 10 of PACAP). The lower panel provides data points representing the degree of binding of the remaining PACAP alanine mutants, i.e., PACAP alanine mutants that bound to the tested antibody similar to wild-type PACAP. Based thereon, the residue was determined to likely not be important for antibody binding. As a positive control, both the upper and lower panels for each Figure also disclose the binding data obtained using wild-type PACAP (labeled huPACAP(1-38)).

FIGS. 46A-47B summarizes the PACAP residue positions determined to contribute to antibody binding affinity based on data obtained in these alanine scanning studies. The positions listed in each column identify the PACAP alanine scanning mutants whose mutation led to a decrease in PACAP/antibody binding affinity. The residue positions are listed in column 3 of FIGS. 46A-47B according to the spatial arrangement of the residues along the PACAP primary sequence (from amino acid residue 1-38). The PACAP residue positions contributing most to antibody binding were interpreted to jointly comprise the epitopes bound by each antibody. Based on data obtained in these alanine scanning studies, the epitopes bound by each antibody were concluded to comprise the following residues:

(i) Ab1: residues 5, 6, 8, 10, and 13 of human PACAP;

(ii) Ab2: residues 5, 6, 8, 9, 10, 13, and 14 of human PACAP;

(iii) Ab13: residues 6, 8, 9, 10, and 13 of human PACAP;

(iv) Ab14: residues 5, 6, 8, 9, 10, and 13 of human PACAP;

(v) Ab15: residues 5, 6, 8, 9, 10, 12, 13, and 14 of human PACAP;

(vi) Ab16: residues 5, 6, 8, 10, and 13 of human PACAP;

(vii) Ab17: residues 5, 6, 8, 10, and 13 of human PACAP;

(viii) Ab18: residues 5, 6, 8, 9, 10, 12, and 13 of human PACAP;

(ix) Ab19: residues 4, 5, 6, 8, 9, 10, 12, 13, 14, and 17 of human PACAP;

(x) Ab5: residues 3, 4, 5, 6, 7, 10, 13, and 14 of human PACAP;

(xi) Ab7: residues 6, 8, 10, 11, 13, 14, and 18 of human PACAP;

(xii) Ab11: residues 6, 8, 10, 11, 13, 14, 18, and 22 of human PACAP;

(xiii) Ab12: residues 6, 8, 10, 11, 13, 14, and 18 of human PACAP;

(xiv) Ab4: residues 8, 9, 10, 13, 14, 17, and 18 of human PACAP;

(xv) Ab3: residues 8, 9, 10, 11, 12, 13, 14, 17, and 21 of human PACAP;

(xvi) Ab6: residues 5, 6, 9, 10, 12, 13, 14, and 17 of human PACAP;

(xvii) Ab8: residues 7, 10, 13, and 14 of human PACAP;

(xviii) Ab9: residues 7, 10, 12, 13, 14, and 17 of human PACAP;

(xix) Ab22: residues 22, 23, 27, 28, and 31 of human PACAP; and (xx) Ab23: residues 12, 20, 23, 24, 26, 27, and 28 of human PACAP.

It was further noted based on the alanine scanning experimental results that the affinity of each of antibodies Ab1, Ab2, Ab13, Ab14, Ab15, Ab16, Ab17, Ab18, Ab19, Ab5, Ab7, Ab11, Ab12, Ab4, Ab3, Ab6, Ab8, and Ab9 for PACAP involves or depends on residues 10 and/or 13 of human PACAP, and in some instances involves or further depends on residues 8 and/or 14.

Additionally, it was observed that the affinity of each of antibodies Ab22 and Ab23 to PACAP involves or requires specific amino acid residues that are present in human wild-type PACAP38, but which are not present in human wild-type PACAP27, e.g., residues 28 or 31 of PACAP38.

With respect to the foregoing alanine scanning results humanized variants of the subject anti-PACAP antibodies should interact with the identical or substantially identical residues of human PACAP as humanization should not appreciably impact the specificity of the binding of the humanized anti-PACAP antibody to human PACAP compared to the parent (unhumanized) antibody. Particularly, Ab3.H should interact with the same residues on human PACAP as Ab3, Ab4.H should interact with the same residues on human PACAP as Ab4, Ab5.H should interact with the same residues on human PACAP as Ab5, Ab9.H should interact with the same residues on human PACAP Ab9, and Ab12.H should interact with the same residues on human PACAP as Ab12.

Antibodies which bind to the same or overlapping epitopes on human PACAP as the subject antibodies may be produced and identified using method described herein. It is reasonable to anticipate that antibodies which bind to the same or overlapping epitope as any of the antibodies identified herein will likely possess similar biological activity absent a meaningful difference in binding kinetics. Particularly, such antibodies should antagonize one or more of the biological effects elicited by PACAP analogously to the exemplified anti-PACAP antibodies which bind these epitopes. Additionally, antibodies that bind to these same or overlapping epitopes, or a subset of residues thereof, are anticipated to mimic the binding characteristics of the subject antibodies. For example such antibodies are expected to selectively bind to PACAP and not bind or bind with much less affinity (weaker) to VIP or other peptides within this family of neuropeptides.

Having fully described and enabled the invention, the invention is further described by the claims that follow.

SEQUENCE LISTING (1246 sequences)

SEQ ID NO: 1 - protein, 443 aa, Artificial
  Humanized antibody sequence
QSVEESGGRLVTPGTPLTLTCTVSGFSLSSAVMNWVRQAPGKGLEWIGSIVASGTTYYASWANGRFTISKTSSTTMDLKMTSPTTEDTATYFCARGGGEFFIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 113 aa, Artificial
  Humanized antibody sequence
QSVEESGGRLVTPGTPLTLTCTVSGFSLSSAVMNWVRQAPGKGLEWIGSIVASGTTYYASWANGRFTISKTSSTTMDLKMTSPTTEDTATYFCARGGGEFFIWGPGTLVTVSS

SEQ ID NO: 3 - protein, 29 aa, Oryctolagus cuniculus
QSVEESGGRLVTPGTPLTLTCTVSGFSLS

SEQ ID NO: 4 - protein, 5 aa, Oryctolagus cuniculus
SAVMN

SEQ ID NO: 5 - protein, 14 aa, Oryctolagus cuniculus
WVRQAPGKGLEWIG

SEQ ID NO: 6 - protein, 16 aa, Oryctolagus cuniculus
SIVASGTTYYASWANG

SEQ ID NO: 7 - protein, 31 aa, Oryctolagus cuniculus
RFTISKTSSTTMDLKMTSPTTEDTATYFCAR

SEQ ID NO: 8 - protein, 7 aa, Oryctolagus cuniculus
GGGEFFI

SEQ ID NO: 9 - protein, 11 aa, Artificial
  Humanized antibody sequence
WGPGTLVTVSS

SEQ ID NO: 10 - protein, 330 aa, Artificial
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - DNA, 1329 bp, Artificial
  Humanized antibody sequence
cagtcggtggaggagtccgggggtcgcctggtcacgcctgggacacccctgacactcacctgcaccgtctctggattctccctcagtagcgctgtaatgaattgggtccgccaggctccagggaaggggctggaatggatcggaagtattgttgctagtggtaccacatactacgcgagctgggcgaacggccgattcaccatctccaaaacctcgtcgaccacgatggatctgaaaatgaccagtccgacaaccgaggacacggccacctatttctgtgccagagggggaggggaatttttcatctggggcccggggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 12 - DNA, 339 bp, Artificial
  Humanized antibody sequence
cagtcggtggaggagtccgggggtcgcctggtcacgcctgggacacccctgacactcacctgcaccgtctctggattctccctcagtagcgctgtaatgaattgggtccgccaggctccagggaaggggctggaatggatcggaagtattgttgctagtggtaccacatactacgcgagctgggcgaacggccgattcaccatctccaaaacctcgtcgaccacgatggatctgaaaatgaccagtccgacaaccgaggacacggccacctatttctgtgccagagggggaggggaatttttcatctggggcccggggaccctcgtcaccgtctcgagc

SEQ ID NO: 13 - DNA, 87 bp, Oryctolagus cuniculus
cagtcggtggaggagtccgggggtcgcctggtcacgcctgggacacccctgacactcacctgcaccgtctctggattctccctcagt

SEQ ID NO: 14 - DNA, 15 bp, Oryctolagus cuniculus
agcgctgtaatgaat

SEQ ID NO: 15 - DNA, 42 bp, Oryctolagus cuniculus
tgggtccgccaggctccagggaaggggctggaatggatcgga

SEQ ID NO: 16 - DNA, 48 bp, Oryctolagus cuniculus
agtattgttgctagtggtaccacatactacgcgagctgggcgaacggc

SEQ ID NO: 17 - DNA, 93 bp, Oryctolagus cuniculus
cgattcaccatctccaaaacctcgtcgaccacgatggatctgaaaatgaccagtccgacaaccgaggacacggccacctatttctgtgccaga

SEQ ID NO: 18 - DNA, 21 bp, Oryctolagus cuniculus
gggggaggggaatttttcatc

SEQ ID NO: 19 - DNA, 33 bp, Artificial
  Humanized antibody sequence
tggggcccggggaccctcgtcaccgtctcgagc

SEQ ID NO: 20 - DNA, 990 bp, Artificial
  Humanized antibody sequence
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 21 - protein, 216 aa, Artificial
  Humanized antibody sequence
DPVMTQTPSSTSAAVGGTVTISCQSSESVYSNYLSWYQQKPGQPPNFLIYQASNLASGVPSRFKGSGSGTQFTLTITDLECDDAATYYCAGGYSENIVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 110 aa, Artificial
  Humanized antibody sequence
DPVMTQTPSSTSAAVGGTVTISCQSSESVYSNYLSWYQQKPGQPPNFLIYQASNLASGVPSRFKGSGSGTQFTLTITDLECDDAATYYCAGGYSENIVGFGGGTEVVVKR

SEQ ID NO: 23 - protein, 23 aa, Oryctolagus cuniculus
DPVMTQTPSSTSAAVGGTVTISC

SEQ ID NO: 24 - protein, 12 aa, Oryctolagus cuniculus
QSSESVYSNYLS

SEQ ID NO: 25 - protein, 15 aa, Oryctolagus cuniculus
WYQQKPGQPPNFLIY

SEQ ID NO: 26 - protein, 7 aa, Oryctolagus cuniculus
QASNLAS

SEQ ID NO: 27 - protein, 32 aa, Oryctolagus cuniculus
GVPSRFKGSGSGTQFTLTITDLECDDAATYYC

SEQ ID NO: 28 - protein, 10 aa, Oryctolagus cuniculus
AGGYSENIVG

SEQ ID NO: 29 - protein, 11 aa, Artificial
  Humanized antibody sequence
FGGGTEVVVKR

SEQ ID NO: 30 - protein, 106 aa, Artificial
  Humanized antibody sequence
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31 - DNA, 648 bp, Artificial
  Humanized antibody sequence
gaccctgtgatgacccagactccatcttccacgtctgcggctgtgggaggcacagtcaccatcagttgccagtccagtgagagtgtttatagtaactacttatcctggtatcagcagaaaccagggcagcctcccaacttcctgatctaccaggcatccaatttggcatctggggtcccatcgcggttcaaaggcagtggatctgggacacagttcactctcaccatcaccgacctggagtgtgacgatgccgccacttattactgtgcaggcggttatagtgaaaacattgttggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 32 - DNA, 330 bp, Artificial
  Humanized antibody sequence
gaccctgtgatgacccagactccatcttccacgtctgcggctgtgggaggcacagtcaccatcagttgccagtccagtgagagtgtttatagtaactacttatcctggtatcagcagaaaccagggcagcctcccaacttcctgatctaccaggcatccaatttggcatctggggtcccatcgcggttcaaaggcagtggatctgggacacagttcactctcaccatcaccgacctggagtgtgacgatgccgccacttattactgtgcaggcggttatagtgaaaacattgttggtttcggcggagggaccgaggtggtggtcaaacgt

SEQ ID NO: 33 - DNA, 69 bp, Oryctolagus cuniculus
gaccctgtgatgacccagactccatcttccacgtctgcggctgtgggaggcacagtcaccatcagttgc

SEQ ID NO: 34 - DNA, 36 bp, Oryctolagus cuniculus
cagtccagtgagagtgtttatagtaactacttatcc

SEQ ID NO: 35 - DNA, 45 bp, Oryctolagus cuniculus
tggtatcagcagaaaccagggcagcctcccaacttcctgatctac

SEQ ID NO: 36 - DNA, 21 bp, Oryctolagus cuniculus
caggcatccaatttggcatct

SEQ ID NO: 37 - DNA, 96 bp, Oryctolagus cuniculus
ggggtcccatcgcggttcaaaggcagtggatctgggacacagttcactctcaccatcaccgacctggagtgtgacgatgccgccacttattactgt

SEQ ID NO: 38 - DNA, 30 bp, Oryctolagus cuniculus
gcaggcggttatagtgaaaacattgttggt

SEQ ID NO: 39 - DNA, 33 bp, Artificial
  Humanized antibody sequence
ttcggcggagggaccgaggtggtggtcaaacgt

SEQ ID NO: 40 - DNA, 318 bp, Artificial
  Humanized antibody sequence
acggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 41 - protein, 445 aa, Artificial
  Humanized antibody sequence
EVQLVESGGGLVQPGGSLRLSCAASGFTVSSAVMNWVRQAPGKGLEWIGSIVASGTTYYASSANGRFTISRDNSKNTLYLQMNSLRAEDTAVYYCARGGGEFFIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 115 aa, Artificial
  Humanized antibody sequence
EVQLVESGGGLVQPGGSLRLSCAASGFTVSSAVMNWVRQAPGKGLEWIGSIVASGTTYYASSANGRFTISRDNSKNTLYLQMNSLRAEDTAVYYCARGGGEFFIWGQGTLVTVSS

SEQ ID NO: 43 - protein, 30 aa, Artificial
  Humanized antibody sequence
EVQLVESGGGLVQPGGSLRLSCAASGFTVS

SEQ ID NO: 44 - protein, 5 aa, Oryctolagus cuniculus
SAVMN

SEQ ID NO: 45 - protein, 14 aa, Artificial
  Humanized antibody sequence
WVRQAPGKGLEWIG

SEQ ID NO: 46 - protein, 16 aa, Artificial
  Humanized antibody sequence
SIVASGTTYYASSANG

SEQ ID NO: 47 - protein, 32 aa, Artificial
  Humanized antibody sequence
RFTISRDNSKNTLYLQMNSLRAEDTAVYYCAR

SEQ ID NO: 48 - protein, 7 aa, Oryctolagus cuniculus
GGGEFFI

SEQ ID NO: 49 - protein, 11 aa, Artificial
  Humanized antibody sequence
WGQGTLVTVSS

SEQ ID NO: 50 - protein, 330 aa, Artificial
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 51 - DNA, 1335 bp, Artificial
  Humanized antibody sequence
gaggtgcagcttgtggagtctgggggaggcttggtccagcctggggggtccctgagactctcctgtgcagcctctggattcaccgtcagtagcgctgtaatgaattgggtccgtcaggctccagggaaggggctggagtggatcggaagtattgttgctagtggtaccacatactacgctagctctgctaacggccgattcaccatctccagagacaattccaagaacaccctgtatcttcaaatgaacagcctgagagctgaggacactgctgtgtattactgtgctagagggggaggggaatttttcatctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 52 - DNA, 345 bp, Artificial
  Humanized antibody sequence
gaggtgcagcttgtggagtctgggggaggcttggtccagcctggggggtccctgagactctcctgtgcagcctctggattcaccgtcagtagcgctgtaatgaattgggtccgtcaggctccagggaaggggctggagtggatcggaagtattgttgctagtggtaccacatactacgctagctctgctaacggccgattcaccatctccagagacaattccaagaacaccctgtatcttcaaatgaacagcctgagagctgaggacactgctgtgtattactgtgctagagggggaggggaatttttcatctggggccaagggaccctcgtcaccgtctcgagc

SEQ ID NO: 53 - DNA, 90 bp, Artificial
  Humanized antibody sequence
gaggtgcagcttgtggagtctgggggaggcttggtccagcctggggggtccctgagactctcctgtgcagcctctggattcaccgtcagt

SEQ ID NO: 54 - DNA, 15 bp, Oryctolagus cuniculus
agcgctgtaatgaat

SEQ ID NO: 55 - DNA, 42 bp, Artificial
  Humanized antibody sequence
tgggtccgtcaggctccagggaaggggctggagtggatcgga

SEQ ID NO: 56 - DNA, 48 bp, Artificial
  Humanized antibody sequence
agtattgttgctagtggtaccacatactacgctagctctgctaacggc

SEQ ID NO: 57 - DNA, 96 bp, Artificial
  Humanized antibody sequence
cgattcaccatctccagagacaattccaagaacaccctgtatcttcaaatgaacagcctgagagctgaggacactgctgtgtattactgtgctaga

SEQ ID NO: 58 - DNA, 21 bp, Oryctolagus cuniculus
gggggaggggaatttttcatc

SEQ ID NO: 59 - DNA, 33 bp, Artificial
  Humanized antibody sequence
tggggccaagggaccctcgtcaccgtctcgagc

SEQ ID NO: 60 - DNA, 990 bp, Artificial
  Humanized antibody sequence
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 61 - protein, 216 aa, Artificial
  Humanized antibody sequence
DIQMTQSPSTLSASVGDRVTITCQSSESVYSNYLSWYQQKPGKAPKFLIYQASNLASGVPSRFSGSGSGTEFTLTISSLQPDDFATYYCAGGYSENIVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 110 aa, Artificial
  Humanized antibody sequence
DIQMTQSPSTLSASVGDRVTITCQSSESVYSNYLSWYQQKPGKAPKFLIYQASNLASGVPSRFSGSGSGTEFTLTISSLQPDDFATYYCAGGYSENIVGFGGGTKVEIKR

SEQ ID NO: 63 - protein, 23 aa, Artificial
  Humanized antibody sequence
DIQMTQSPSTLSASVGDRVTITC

SEQ ID NO: 64 - protein, 12 aa, Oryctolagus cuniculus
QSSESVYSNYLS

SEQ ID NO: 65 - protein, 15 aa, Artificial
  Humanized antibody sequence
WYQQKPGKAPKFLIY

SEQ ID NO: 66 - protein, 7 aa, Oryctolagus cuniculus
QASNLAS

SEQ ID NO: 67 - protein, 32 aa, Artificial
  Humanized antibody sequence
GVPSRFSGSGSGTEFTLTISSLQPDDFATYYC

SEQ ID NO: 68 - protein, 10 aa, Oryctolagus cuniculus
AGGYSENIVG

SEQ ID NO: 69 - protein, 11 aa, Artificial
  Humanized antibody sequence
FGGGTKVEIKR

SEQ ID NO: 70 - protein, 106 aa, Artificial; identical to SEQ ID NO: 30
  Humanized antibody sequence

SEQ ID NO: 71 - DNA, 648 bp, Artificial
  Humanized antibody sequence
gacatccagatgacccagtctccttccaccctgtctgcatctgtaggagacagagtcaccatcacttgtcagtccagtgagagtgtttatagtaactacttatcctggtatcagcagaaaccaggaaaagcccctaagttcctgatctatcaggcatccaatttggcatctggagtcccatcaaggttcagcggcagtggatctggaacagaattcactctcaccatcagcagcctgcagcctgatgattttgcaacttactactgtgcaggcggttatagtgaaaacattgttggtttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 72 - DNA, 330 bp, Artificial
  Humanized antibody sequence
gacatccagatgacccagtctccttccaccctgtctgcatctgtaggagacagagtcaccatcacttgtcagtccagtgagagtgtttatagtaactacttatcctggtatcagcagaaaccaggaaaagcccctaagttcctgatctatcaggcatccaatttggcatctggagtcccatcaaggttcagcggcagtggatctggaacagaattcactctcaccatcagcagcctgcagcctgatgattttgcaacttactactgtgcaggcggttatagtgaaaacattgttggtttcggcggaggaaccaaggtggaaatcaaacgt

SEQ ID NO: 73 - DNA, 69 bp, Artificial
  Humanized antibody sequence
gacatccagatgacccagtctccttccaccctgtctgcatctgtaggagacagagtcaccatcacttgt

SEQ ID NO: 74 - DNA, 36 bp, Oryctolagus cuniculus; identical to SEQ ID NO: 34

SEQ ID NO: 75 - DNA, 45 bp, Artificial
  Humanized antibody sequence
tggtatcagcagaaaccaggaaaagcccctaagttcctgatctat

SEQ ID NO: 76 - DNA, 21 bp, Oryctolagus cuniculus
caggcatccaatttggcatct

SEQ ID NO: 77 - DNA, 96 bp, Artificial
  Humanized antibody sequence
ggagtcccatcaaggttcagcggcagtggatctggaacagaattcactctcaccatcagcagcctgcagcctgatgattttgcaacttactactgt

SEQ ID NO: 78 - DNA, 30 bp, Oryctolagus cuniculus; identical to SEQ ID NO: 38

SEQ ID NO: 79 - DNA, 33 bp, Artificial
  Humanized antibody sequence
ttcggcggaggaaccaaggtggaaatcaaacgt

SEQ ID NO: 80 - DNA, 318 bp, Artificial; identical to SEQ ID NO: 40
  Humanized antibody sequence

SEQ ID NO: 81 - protein, 443 aa, Artificial
  Humanized antibody sequence
QSVEESGGRLVTPGTPLTLTCTVSGFSLSGAAMNWVRQAPGKGLEWIGVIGNSGSTYYASWAKGRFTISKTSSTTVDLKMTSPTTEDTATYFCARGGGEFFIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 113 aa, Artificial
  Humanized antibody sequence
QSVEESGGRLVTPGTPLTLTCTVSGFSLSGAAMNWVRQAPGKGLEWIGVIGNSGSTYYASWAKGRFTISKTSSTTVDLKMTSPTTEDTATYFCARGGGEFFIWGQGTLVTVSS

SEQ ID NO: 83 - protein, 29 aa, Oryctolagus cuniculus
QSVEESGGRLVTPGTPLTLTCTVSGFSLS

SEQ ID NO: 84 - protein, 5 aa, Oryctolagus cuniculus
GAAMN

SEQ ID NO: 85 - protein, 14 aa, Oryctolagus cuniculus
WVRQAPGKGLEWIG

SEQ ID NO: 86 - protein, 16 aa, Oryctolagus cuniculus
VIGNSGSTYYASWAKG

SEQ ID NO: 87 - protein, 31 aa, Oryctolagus cuniculus
RFTISKTSSTTVDLKMTSPTTEDTATYFCAR

SEQ ID NO: 88 - protein, 7 aa, Oryctolagus cuniculus
GGGEFFI

SEQ ID NO: 89 - protein, 11 aa, Artificial
  Humanized antibody sequence
WGQGTLVTVSS

SEQ ID NO: 90 - protein, 330 aa, Artificial; identical to SEQ ID NO: 10
  Humanized antibody sequence

SEQ ID NO: 91 - DNA, 1329 bp, Artificial
  Humanized antibody sequence
cagtcggtggaggagtccgggggtcgcctggtcacgcctgggacacccctgacactcacctgcaccgtctctggattctccctcagtggcgctgcgatgaactgggtccgccaggctccagggaaggggctggaatggatcggagttattggtaatagtggtagcacatactacgcgtcctgggcgaaaggccgattcaccatctccaaaacctcgtcgaccacggtggatctgaaaatgaccagtccgacaaccgaggacacggccacctatttctgtgccagagggggaggggaatttttcatctggggccaagggaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 92 - DNA, 339 bp, Artificial
  Humanized antibody sequence
cagtcggtggaggagtccgggggtcgcctggtcacgcctgggacacccctgacactcacctgcaccgtctctggattctccctcagtggcgctgcgatgaactgggtccgccaggctccagggaaggggctggaatggatcggagttattggtaatagtggtagcacatactacgcgtcctgggcgaaaggccgattcaccatctccaaaacctcgtcgaccacggtggatctgaaaatgaccagtccgacaaccgaggacacggccacctatttctgtgccagagggggaggggaatttttcatctggggccaagggaccctggtcaccgtctcgagc

SEQ ID NO: 93 - DNA, 87 bp, Oryctolagus cuniculus; identical to SEQ ID NO: 13

SEQ ID NO: 94 - DNA, 15 bp, Oryctolagus cuniculus
ggcgctgcgatgaac

SEQ ID NO: 95 - DNA, 42 bp, Oryctolagus cuniculus; identical to SEQ ID NO: 15

SEQ ID NO: 96 - DNA, 48 bp, Oryctolagus cuniculus
gttattggtaatagtggtagcacatactacgcgtcctgggcgaaaggc

SEQ ID NO: 97 - DNA, 93 bp, Oryctolagus cuniculus
cgattcaccatctccaaaacctcgtcgaccacggtggatctgaaaatgaccagtccgacaaccgaggacacggccacctatttctgtgccaga

SEQ ID NO: 98 - DNA, 21 bp, Oryctolagus cuniculus
gggggaggggaatttttcatc

SEQ ID NO: 99 - DNA, 33 bp, Artificial
  Humanized antibody sequence
tggggccaagggaccctggtcaccgtctcgagc

SEQ ID NO: 100 - DNA, 990 bp, Artificial; identical to SEQ ID NO: 20
  Humanized antibody sequence

SEQ ID NO: 101 - protein, 217 aa, Artificial
  Humanized antibody sequence
AQVLTQTPSPVSAAVGGTVTINCQSSESVYKNNYLSWYQQKPGQPPKFLIYQASNLADGVPSRFKGSGSGTQFTLTISDLECDDAATYYCAGGYSTYMSGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 111 aa, Artificial
  Humanized antibody sequence
AQVLTQTPSPVSAAVGGTVTINCQSSESVYKNNYLSWYQQKPGQPPKFLIYQASNLADGVPSRFKGSGSGTQFTLTISDLECDDAATYYCAGGYSTYMSGFGGGTEVVVKR

SEQ ID NO: 103 - protein, 23 aa, Oryctolagus cuniculus
AQVLTQTPSPVSAAVGGTVTINC

SEQ ID NO: 104 - protein, 13 aa, Oryctolagus cuniculus
QSSESVYKNNYLS

SEQ ID NO: 105 - protein, 15 aa, Oryctolagus cuniculus
WYQQKPGQPPKFLIY

SEQ ID NO: 106 - protein, 7 aa, Oryctolagus cuniculus
QASNLAD

SEQ ID NO: 107 - protein, 32 aa, Oryctolagus cuniculus
GVPSRFKGSGSGTQFTLTISDLECDDAATYYC

SEQ ID NO: 108 - protein, 10 aa, Oryctolagus cuniculus
AGGYSTYMSG

SEQ ID NO: 109 - protein, 11 aa, Artificial
  Humanized antibody sequence
FGGGTEVVVKR

SEQ ID NO: 110 - protein, 106 aa, Artificial; identical to SEQ ID NO: 30
  Humanized antibody sequence

SEQ ID NO: 111 - DNA, 651 bp, Artificial
  Humanized antibody sequence
gcccaagtgctgacccagactccatccccagtgtctgcagctgtgggaggcaccgtcaccatcaattgccagtccagtgagagtgtttataagaacaactacttatcctggtatcagcagaaaccagggcagcctcccaagttcctgatctaccaggcatccaatttggcagatggggtcccatcgcggttcaaaggcagtggatctgggacacagttcactctcaccatcagcgacctggagtgtgacgatgccgccacttattactgtgcaggcggttatagtacttatatgtctggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 112 - DNA, 333 bp, Artificial
  Humanized antibody sequence
gcccaagtgctgacccagactccatccccagtgtctgcagctgtgggaggcaccgtcaccatcaattgccagtccagtgagagtgtttataagaacaactacttatcctggtatcagcagaaaccagggcagcctcccaagttcctgatctaccaggcatccaatttggcagatggggtcccatcgcggttcaaaggcagtggatctgggacacagttcactctcaccatcagcgacctggagtgtgacgatgccgccacttattactgtgcaggcggttatagtacttatatgtctggtttcggcggagggaccgaggtggtggtcaaacgt

SEQ ID NO: 113 - DNA, 69 bp, Oryctolagus cuniculus
gcccaagtgctgacccagactccatccccagtgtctgcagctgtgggaggcaccgtcaccatcaattgc

SEQ ID NO: 114 - DNA, 39 bp, Oryctolagus cuniculus
cagtccagtgagagtgtttataagaacaactacttatcc

SEQ ID NO: 115 - DNA, 45 bp, Oryctolagus cuniculus
tggtatcagcagaaaccagggcagcctcccaagttcctgatctac

SEQ ID NO: 116 - DNA, 21 bp, Oryctolagus cuniculus
caggcatccaatttggcagat

SEQ ID NO: 117 - DNA, 96 bp, Oryctolagus cuniculus
ggggtcccatcgcggttcaaaggcagtggatctgggacacagttcactctcaccatcagcgacctggagtgtgacgatgccgccacttattactgt

SEQ ID NO: 118 - DNA, 30 bp, Oryctolagus cuniculus
gcaggcggttatagtacttatatgtctggt

SEQ ID NO: 119 - DNA, 33 bp, Artificial; identical to SEQ ID NO: 39
  Humanized antibody sequence

SEQ ID NO: 120 - DNA, 318 bp, Artificial; identical to SEQ ID NO: 40
  Humanized antibody sequence

SEQ ID NO: 121 - protein, 443 aa, Artificial
  Humanized antibody sequence
QSVEESGGRLVTPGTPLTLTCTVSGFSLSSAAMNWVRQAPGKGLEWIGIIDNTAGTYYAPWAKGRFTISKTSSTTVDLKMTSPTTEDTATYFCARGGGEFFIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 113 aa, Artificial
  Humanized antibody sequence
QSVEESGGRLVTPGTPLTLTCTVSGFSLSSAAMNWVRQAPGKGLEWIGIIDNTAGTYYAPWAKGRFTISKTSSTTVDLKMTSPTTEDTATYFCARGGGEFFIWGPGTLVTVSS

SEQ ID NO: 123 - protein, 29 aa, Oryctolagus cuniculus
QSVEESGGRLVTPGTPLTLTCTVSGFSLS

SEQ ID NO: 124 - protein, 5 aa, Oryctolagus cuniculus
SAAMN

SEQ ID NO: 125 - protein, 14 aa, Oryctolagus cuniculus
WVRQAPGKGLEWIG

SEQ ID NO: 126 - protein, 16 aa, Oryctolagus cuniculus
IIDNTAGTYYAPWAKG

SEQ ID NO: 127 - protein, 31 aa, Oryctolagus cuniculus; identical to SEQ ID NO: 87

SEQ ID NO: 128 - protein, 7 aa, Oryctolagus cuniculus
GGGEFFI

SEQ ID NO: 129 - protein, 11 aa, Artificial
  Humanized antibody sequence
WGPGTLVTVSS

SEQ ID NO: 130 - protein, 330 aa, Artificial; identical to SEQ ID NO: 50
  Humanized antibody sequence

SEQ ID NO: 131 - DNA, 1329 bp, Artificial
  Humanized antibody sequence
cagtcggtggaggagtccgggggtcgcctggtcacgcctgggacacccctgacactcacctgcaccgtctctggattctccctcagtagcgctgcaatgaactgggtccgccaggctccagggaaggggctggaatggatcggaattattgataatactgctggcacatattacgcgccctgggcgaaaggccgattcaccatctccaaaacctcgtcgaccacggtggatctgaaaatgaccagtccgacaaccgaggacacggccacctatttctgtgccagagggggaggggaatttttcatctggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 132 - DNA, 339 bp, Artificial
  Humanized antibody sequence
cagtcggtggaggagtccgggggtcgcctggtcacgcctgggacacccctgacactcacctgcaccgtctctggattctccctcagtagcgctgcaatgaactgggtccgccaggctccagggaaggggctggaatggatcggaattattgataatactgctggcacatattacgcgccctgggcgaaaggccgattcaccatctccaaaacctcgtcgaccacggtggatctgaaaatgaccagtccgacaaccgaggacacggccacctatttctgtgccagagggggaggggaatttttcatctggggcccgggcaccctcgtcaccgtctcgagc

SEQ ID NO: 133 - DNA, 87 bp, Oryctolagus cuniculus; identical to SEQ ID NO: 13

SEQ ID NO: 134 - DNA, 15 bp, Oryctolagus cuniculus
agcgctgcaatgaac

SEQ ID NO: 135 - DNA, 42 bp, Oryctolagus cuniculus; identical to SEQ ID NO: 15

SEQ ID NO: 136 - DNA, 48 bp, Oryctolagus cuniculus
attattgataatactgctggcacatattacgcgccctgggcgaaaggc

SEQ ID NO: 137 - DNA, 93 bp, Oryctolagus cuniculus; identical to SEQ ID NO: 97

SEQ ID NO: 138 - DNA, 21 bp, Oryctolagus cuniculus
gggggaggggaatttttcatc

SEQ ID NO: 139 - DNA, 33 bp, Artificial
  Humanized antibody sequence
tggggcccgggcaccctcgtcaccgtctcgagc

SEQ ID NO: 140 - DNA, 990 bp, Artificial; identical to SEQ ID NO: 60
  Humanized antibody sequence

SEQ ID NO: 141 - protein, 217 aa, Artificial
  Humanized antibody sequence
AQVLTQTPSSVSAAVGGTVTINCQSSQSVHDGSYLSWYQQKPGQPPNFLIYQASNLASGVPSRFKGSGSGTQFTLTISDLECDDAATYYCAGGYSSNICGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - protein, 111 aa, Artificial
  Humanized antibody sequence
AQVLTQTPSSVSAAVGGTVTINCQSSQSVHDGSYLSWYQQKPGQPPNFLIYQASNLASGVPSRFKGSGSGTQFTLTISDLECDDAATYYCAGGYSSNICGFGGGTEVVVKR

SEQ ID NO: 143 - protein, 23 aa, Oryctolagus cuniculus
AQVLTQTPSSVSAAVGGTVTINC

SEQ ID NO: 144 - protein, 13 aa, Oryctolagus cuniculus
QSSQSVHDGSYLS

SEQ ID NO: 145 - protein, 15 aa, Oryctolagus cuniculus
WYQQKPGQPPNFLIY

SEQ ID NO: 146 - protein, 7 aa, Oryctolagus cuniculus
QASNLAS

SEQ ID NO: 147 - protein, 32 aa, Oryctolagus cuniculus; identical to SEQ ID NO: 107

SEQ ID NO: 148 - protein, 10 aa, Oryctolagus cuniculus
AGGYSSNICG

SEQ ID NO: 149 - protein, 11 aa, Artificial
  Humanized antibody sequence
FGGGTEVVVKR

SEQ ID NO: 150 - protein, 106 aa, Artificial; identical to SEQ ID NO: 30
  Humanized antibody sequence

SEQ ID NO: 151 - DNA, 651 bp, Artificial
  Humanized antibody sequence
gcgcaagtgctgacccagactccatcgtccgtgtctgcagctgtgggaggcacagtcaccatcaattgccagtccagtcagagtgttcatgatggcagctacttatcctggtatcagcagaaaccagggcagcctcccaacttcctgatctaccaggcatccaatttggcatctggggtcccatcgcggttcaaaggcagtggatctgggacacagttcactctcaccatcagcgacctggagtgtgacgatgccgccacttattactgtgcaggcggttatagtagtaatatttgtggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 152 - DNA, 333 bp, Artificial
  Humanized antibody sequence
gcgcaagtgctgacccagactccatcgtccgtgtctgcagctgtgggaggcacagtcaccatcaattgccagtccagtcagagtgttcatgatggcagctacttatcctggtatcagcagaaaccagggcagcctcccaacttcctgatctaccaggcatccaatttggcatctggggtcccatcgcggttcaaaggcagtggatctgggacacagttcactctcaccatcagcgacctggagtgtgacgatgccgccacttattactgtgcaggcggttatagtagtaatatttgtggtttcggcggagggaccgaggtggtggtcaaacgt

SEQ ID NO: 153 - DNA, 69 bp, Oryctolagus cuniculus
gcgcaagtgctgacccagactccatcgtccgtgtctgcagctgtgggaggcacagtcaccatcaattgc

SEQ ID NO: 154 - DNA, 39 bp, Oryctolagus cuniculus
cagtccagtcagagtgttcatgatggcagctacttatcc

SEQ ID NO: 155 - DNA, 45 bp, Oryctolagus cuniculus; identical to SEQ ID NO: 35

SEQ ID NO: 156 - DNA, 21 bp, Oryctolagus cuniculus
caggcatccaatttggcatct

SEQ ID NO: 157 - DNA, 96 bp, Oryctolagus cuniculus; identical to SEQ ID NO: 117

SEQ ID NO: 158 - DNA, 30 bp, Oryctolagus cuniculus
gcaggcggttatagtagtaatatttgtggt

SEQ ID NO: 159 - DNA, 33 bp, Artificial; identical to SEQ ID NO: 39
  Humanized antibody sequence

SEQ ID NO: 160 - DNA, 318 bp, Artificial; identical to SEQ ID NO: 40
  Humanized antibody sequence

SEQ ID NO: 161 - protein, 443 aa, Artificial
  Humanized antibody sequence
QSVEASGGRLVTPGTPLTLTCTVSGFSLSSAAMNWVRQAPGKGLEWIGFIEYSKNIVYASWAKGRFTISKVSSTTVDLKMTSPTTEDTATYFCARGGGEFFIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 113 aa, Artificial
  Humanized antibody sequence
QSVEASGGRLVTPGTPLTLTCTVSGFSLSSAAMNWVRQAPGKGLEWIGFIEYSKNIVYASWAKGRFTISKVSSTTVDLKMTSPTTEDTATYFCARGGGEFFIWGQGTLVTVSS

SEQ ID NO: 163 - protein, 29 aa, Oryctolagus cuniculus
QSVEASGGRLVTPGTPLTLTCTVSGFSLS

SEQ ID NO: 164 - protein, 5 aa, Oryctolagus cuniculus
SAAMN

SEQ ID NO: 165 - protein, 14 aa, Oryctolagus cuniculus
WVRQAPGKGLEWIG

SEQ ID NO: 166 - protein, 16 aa, Oryctolagus cuniculus
FIEYSKNIVYASWAKG

SEQ ID NO: 167 - protein, 31 aa, Oryctolagus cuniculus
RFTISKVSSTTVDLKMTSPTTEDTATYFCAR

SEQ ID NO: 168 - protein, 7 aa, Oryctolagus cuniculus
GGGEFFI

SEQ ID NO: 169 - protein, 11 aa, Artificial
  Humanized antibody sequence
WGQGTLVTVSS

SEQ ID NO: 170 - protein, 330 aa, Artificial; identical to SEQ ID NO: 50
  Humanized antibody sequence

SEQ ID NO: 171 - DNA, 1329 bp, Artificial
  Humanized antibody sequence
cagtcggtggaggcgtccgggggtcgcctggtcacgcctgggacacccctgacactcacctgcaccgtctctggattctccctcagtagcgctgcaatgaactgggtccgccaggctccagggaaggggctggaatggatcggatttattgagtatagtaagaatatagtttacgcgtcctgggcgaaaggccgattcaccatctccaaagtctcgtcgaccacggtggatctgaaaatgaccagtccgacaaccgaggacacggccacctatttctgtgccagggggggaggggaatttttcatctggggccaaggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 172 - DNA, 339 bp, Artificial
  Humanized antibody sequence
cagtcggtggaggcgtccgggggtcgcctggtcacgcctgggacacccctgacactcacctgcaccgtctctggattctccctcagtagcgctgcaatgaactgggtccgccaggctccagggaaggggctggaatggatcggatttattgagtatagtaagaatatagtttacgcgtcctgggcgaaaggccgattcaccatctccaaagtctcgtcgaccacggtggatctgaaaatgaccagtccgacaaccgaggacacggccacctatttctgtgccagggggggaggggaatttttcatctggggccaaggcaccctggtcaccgtctcgagc

SEQ ID NO: 173 - DNA, 87 bp, Oryctolagus cuniculus
cagtcggtggaggcgtccgggggtcgcctggtcacgcctgggacacccctgacactcacctgcaccgtctctggattctccctcagt

SEQ ID NO: 174 - DNA, 15 bp, Oryctolagus cuniculus
agcgctgcaatgaac

SEQ ID NO: 175 - DNA, 42 bp, Oryctolagus cuniculus; identical to SEQ ID NO: 15

SEQ ID NO: 176 - DNA, 48 bp, Oryctolagus cuniculus
tttattgagtatagtaagaatatagtttacgcgtcctgggcgaaaggc

SEQ ID NO: 177 - DNA, 93 bp, Oryctolagus cuniculus
cgattcaccatctccaaagtctcgtcgaccacggtggatctgaaaatgaccagtccgacaaccgaggacacggccacctatttctgtgccagg

SEQ ID NO: 178 - DNA, 21 bp, Oryctolagus cuniculus
gggggaggggaatttttcatc

SEQ ID NO: 179 - DNA, 33 bp, Artificial
  Humanized antibody sequence
tggggccaaggcaccctggtcaccgtctcgagc

SEQ ID NO: 180 - DNA, 990 bp, Artificial; identical to SEQ ID NO: 60
  Humanized antibody sequence

SEQ ID NO: 181 - protein, 217 aa, Artificial
  Humanized antibody sequence
AQVLTQTPSSVSAAVGGTVTINCQSSQSVYSNNRLSYYQQKPGQPPKLLIYEASSLAYGVPSRFKGSGSGTQFTLTISDLECDDAATYYCAGAYSNSIYSFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 182 - protein, 111 aa, Artificial
  Humanized antibody sequence
AQVLTQTPSSVSAAVGGTVTINCQSSQSVYSNNRLSYYQQKPGQPPKLLIYEASSLAYGVPSRFKGSGSGTQFTLTISDLECDDAATYYCAGAYSNSIYSFGGGTEVVVKR

SEQ ID NO: 183 - protein, 23 aa, Oryctolagus cuniculus
AQVLTQTPSSVSAAVGGTVTINC

SEQ ID NO: 184 - protein, 13 aa, Oryctolagus cuniculus
QSSQSVYSNNRLS

SEQ ID NO: 185 - protein, 15 aa, Oryctolagus cuniculus
YYQQKPGQPPKLLIY

SEQ ID NO: 186 - protein, 7 aa, Oryctolagus cuniculus
EASSLAY

SEQ ID NO: 187 - protein, 32 aa, Oryctolagus cuniculus; identical to SEQ ID NO: 107

SEQ ID NO: 188 - protein, 10 aa, Oryctolagus cuniculus
AGAYSNSIYS

SEQ ID NO: 189 - protein, 11 aa, Artificial
  Humanized antibody sequence
FGGGTEVVVKR

SEQ ID NO: 190 - protein, 106 aa, Artificial; identical to SEQ ID NO: 30
  Humanized antibody sequence

SEQ ID NO: 191 - DNA, 651 bp, Artificial
  Humanized antibody sequence
gcgcaagtgctgacccagactccatcgtccgtgtctgcagctgtgggaggcacagtcaccatcaattgccagtccagtcagagtgtttatagtaacaaccggttatcgtactatcagcagaaaccagggcagcctcccaagctcctgatctacgaagcatccagtctggcatatggggtcccatcgcggttcaaaggcagtggatctgggacacagttcactctcaccatcagcgacctggagtgtgacgatgccgccacttattactgtgcaggtgcctatagtaatagtatttatagtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 192 - DNA, 333 bp, Artificial
  Humanized antibody sequence
gcgcaagtgctgacccagactccatcgtccgtgtctgcagctgtgggaggcacagtcaccatcaattgccagtccagtcagagtgtttatagtaacaaccggttatcgtactatcagcagaaaccagggcagcctcccaagctcctgatctacgaagcatccagtctggcatatggggtcccatcgcggttcaaaggcagtggatctgggacacagttcactctcaccatcagcgacctggagtgtgacgatgccgccacttattactgtgcaggtgcctatagtaatagtatttatagtttcggcggagggaccgaggtggtggtcaaacgt

SEQ ID NO: 193 - DNA, 69 bp, Oryctolagus cuniculus; identical to SEQ ID NO: 153

SEQ ID NO: 194 - DNA, 39 bp, Oryctolagus cuniculus
cagtccagtcagagtgtttatagtaacaaccggttatcg

SEQ ID NO: 195 - DNA, 45 bp, Oryctolagus cuniculus
tactatcagcagaaaccagggcagcctcccaagctcctgatctac

SEQ ID NO: 196 - DNA, 21 bp, Oryctolagus cuniculus
gaagcatccagtctggcatat

SEQ ID NO: 197 - DNA, 96 bp, Oryctolagus cuniculus; identical to SEQ ID NO: 117

SEQ ID NO: 198 - DNA, 30 bp, Oryctolagus cuniculus
gcaggtgcctatagtaatagtatttatagt

SEQ ID NO: 199 - DNA, 33 bp, Artificial; identical to SEQ ID NO: 39
  Humanized antibody sequence

SEQ ID NO: 200 - DNA, 318 bp, Artificial; identical to SEQ ID NO: 40
  Humanized antibody sequence

SEQ ID NO: 201 - protein, 443 aa, Artificial
  Humanized antibody sequence
QSVEASGGHLVTPGTPLTLTCTVSGFSLSSAAMNWVRQAPGKGLEWIGSVDERQNKYYASWAKGRFTISRTSSTTVNLKMTSPTTEDTATYFCARGGGEFFIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 113 aa, Artificial
  Humanized antibody sequence
QSVEASGGHLVTPGTPLTLTCTVSGFSLSSAAMNWVRQAPGKGLEWIGSVDERQNKYYASWAKGRFTISRTSSTTVNLKMTSPTTEDTATYFCARGGGEFFIWGQGTLVTVSS

SEQ ID NO: 203 - protein, 29 aa, Oryctolagus cuniculus
QSVEASGGHLVTPGTPLTLTCTVSGFSLS

SEQ ID NO: 204 - protein, 5 aa, Oryctolagus cuniculus
SAAMN

SEQ ID NO: 205 - protein, 14 aa, Oryctolagus cuniculus
WVRQAPGKGLEWIG

SEQ ID NO: 206 - protein, 16 aa, Oryctolagus cuniculus
SVDERQNKYYASWAKG

SEQ ID NO: 207 - protein, 31 aa, Oryctolagus cuniculus
RFTISRTSSTTVNLKMTSPTTEDTATYFCAR

SEQ ID NO: 208 - protein, 7 aa, Oryctolagus cuniculus
GGGEFFI

SEQ ID NO: 209 - protein, 11 aa, Artificial
  Humanized antibody sequence
WGQGTLVTVSS

SEQ ID NO: 210 - protein, 330 aa, Artificial; identical to SEQ ID NO: 50
  Humanized antibody sequence

SEQ ID NO: 211 - DNA, 1329 bp, Artificial
  Humanized antibody sequence
cagtcggtggaggcgtccgggggtcacctagtcacgcctgggacacccctgacactcacctgcaccgtctctggattctccctcagtagcgctgcaatgaactgggtccgccaggctccagggaaggggctggaatggatcggatcggttgatgagcgtcagaataaatattacgcgtcctgggcgaaaggccgattcaccatctccagaacctcgtcgaccacggtgaatctgaaaatgaccagtccgacaaccgaggacacggccacctatttctgtgccagagggggaggggaatttttcatctggggccagggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 212 - DNA, 339 bp, Artificial
  Humanized antibody sequence
cagtcggtggaggcgtccgggggtcacctagtcacgcctgggacacccctgacactcacctgcaccgtctctggattctccctcagtagcgctgcaatgaactgggtccgccaggctccagggaaggggctggaatggatcggatcggttgatgagcgtcagaataaatattacgcgtcctgggcgaaaggccgattcaccatctccagaacctcgtcgaccacggtgaatctgaaaatgaccagtccgacaaccgaggacacggccacctatttctgtgccagagggggaggggaatttttcatctggggccagggcaccctcgtcaccgtctcgagc

SEQ ID NO: 213 - DNA, 87 bp, Oryctolagus cuniculus
cagtcggtggaggcgtccgggggtcacctagtcacgcctgggacacccctgacactcacctgcaccgtctctggattctccctcagt

SEQ ID NO: 214 - DNA, 15 bp, Oryctolagus cuniculus
agcgctgcaatgaac

SEQ ID NO: 215 - DNA, 42 bp, Oryctolagus cuniculus; identical to SEQ ID NO: 15

SEQ ID NO: 216 - DNA, 48 bp, Oryctolagus cuniculus
tcggttgatgagcgtcagaataaatattacgcgtcctgggcgaaaggc

SEQ ID NO: 217 - DNA, 93 bp, Oryctolagus cuniculus
cgattcaccatctccagaacctcgtcgaccacggtgaatctgaaaatgaccagtccgacaaccgaggacacggccacctatttctgtgccaga

SEQ ID NO: 218 - DNA, 21 bp, Oryctolagus cuniculus
gggggaggggaatttttcatc

SEQ ID NO: 219 - DNA, 33 bp, Artificial
  Humanized antibody sequence
tggggccagggcaccctcgtcaccgtctcgagc

SEQ ID NO: 220 - DNA, 990 bp, Artificial; identical to SEQ ID NO: 60
  Humanized antibody sequence

SEQ ID NO: 221 - protein, 217 aa, Artificial
  Humanized antibody sequence
AQVLTQTPSSVSAAVGGTVTINCQSSQSVYSNNRLSWYQQKPGQPPNLLIYEASSLASGVPSRFSGSGSGTQFTLTISDLECDDAATYYCAGAYNTGIYGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 111 aa, Artificial
  Humanized antibody sequence
AQVLTQTPSSVSAAVGGTVTINCQSSQSVYSNNRLSWYQQKPGQPPNLLIYEASSLASGVPSRFSGSGSGTQFTLTISDLECDDAATYYCAGAYNTGIYGFGGGTEVVVKR

SEQ ID NO: 223 - protein, 23 aa, Oryctolagus cuniculus
AQVLTQTPSSVSAAVGGTVTINC

SEQ ID NO: 224 - protein, 13 aa, Oryctolagus cuniculus
QSSQSVYSNNRLS

SEQ ID NO: 225 - protein, 15 aa, Oryctolagus cuniculus
WYQQKPGQPPNLLIY

SEQ ID NO: 226 - protein, 7 aa, Oryctolagus cuniculus
EASSLAS

SEQ ID NO: 227 - protein, 32 aa, Oryctolagus cuniculus
GVPSRFSGSGSGTQFTLTISDLECDDAATYYC

SEQ ID NO: 228 - protein, 10 aa, Oryctolagus cuniculus
AGAYNTGIYG

SEQ ID NO: 229 - protein, 11 aa, Artificial
  Humanized antibody sequence
FGGGTEVVVKR

SEQ ID NO: 230 - protein, 106 aa, Artificial; identical to SEQ ID NO: 30
  Humanized antibody sequence

SEQ ID NO: 231 - DNA, 651 bp, Artificial
  Humanized antibody sequence
gcgcaagtgctgacccagactccatcgtccgtgtctgcagctgtgggaggcacagtcaccatcaattgccagtccagtcagagtgtttatagtaacaaccgcttatcctggtatcagcagaaaccagggcagcctcccaatctcctgatctacgaagcatccagtctggcatctggggtcccatcgcggttcagcggcagtggatctgggacacagttcactctcaccatcagcgacctggagtgtgacgatgccgccacttattactgtgcaggcgcttataatactgggatttatggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 232 - DNA, 333 bp, Artificial
  Humanized antibody sequence
gcgcaagtgctgacccagactccatcgtccgtgtctgcagctgtgggaggcacagtcaccatcaattgccagtccagtcagagtgtttatagtaacaaccgcttatcctggtatcagcagaaaccagggcagcctcccaatctcctgatctacgaagcatccagtctggcatctggggtcccatcgcggttcagcggcagtggatctgggacacagttcactctcaccatcagcgacctggagtgtgacgatgccgccacttattactgtgcaggcgcttataatactgggatttatggtttcggcggagggaccgaggtggtggtcaaacgt

SEQ ID NO: 233 - DNA, 69 bp, Oryctolagus cuniculus; identical to SEQ ID NO: 153

SEQ ID NO: 234 - DNA, 39 bp, Oryctolagus cuniculus
cagtccagtcagagtgtttatagtaacaaccgcttatcc

SEQ ID NO: 235 - DNA, 45 bp, Oryctolagus cuniculus
tggtatcagcagaaaccagggcagcctcccaatctcctgatctac

SEQ ID NO: 236 - DNA, 21 bp, Oryctolagus cuniculus
gaagcatccagtctggcatct

SEQ ID NO: 237 - DNA, 96 bp, Oryctolagus cuniculus
ggggtcccatcgcggttcagcggcagtggatctgggacacagttcactctcaccatcagcgacctggagtgtgacgatgccgccacttattactgt

SEQ ID NO: 238 - DNA, 30 bp, Oryctolagus cuniculus
gcaggcgcttataatactgggatttatggt

SEQ ID NO: 239 - DNA, 33 bp, Artificial; identical to SEQ ID NO: 39
  Humanized antibody sequence

SEQ ID NO: 240 - DNA, 318 bp, Artificial; identical to SEQ ID NO: 40
  Humanized antibody sequence

SEQ ID NO: 241 - protein, 443 aa, Artificial
  Humanized antibody sequence
QSVEESGGRLVTPGTPLTLTCTVSGFSLSSAAMSWVRQAPGKGLEWIGIIDDSGNTYYASWAKARFTISKTSSTTVDLKMTSPTTEDTATYFCARGGGEFFIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 113 aa, Artificial
  Humanized antibody sequence
QSVEESGGRLVTPGTPLTLTCTVSGFSLSSAAMSWVRQAPGKGLEWIGIIDDSGNTYYASWAKARFTISKTSSTTVDLKMTSPTTEDTATYFCARGGGEFFIWGPGTLVTVSS

SEQ ID NO: 243 - protein, 29 aa, Oryctolagus cuniculus
QSVEESGGRLVTPGTPLTLTCTVSGFSLS

SEQ ID NO: 244 - protein, 5 aa, Oryctolagus cuniculus
SAAMS

SEQ ID NO: 245 - protein, 14 aa, Oryctolagus cuniculus
WVRQAPGKGLEWIG

SEQ ID NO: 246 - protein, 16 aa, Oryctolagus cuniculus
IIDDSGNTYYASWAKA

SEQ ID NO: 247 - protein, 31 aa, Oryctolagus cuniculus; identical to SEQ ID NO: 87

SEQ ID NO: 248 - protein, 7 aa, Oryctolagus cuniculus
GGGEFFI

SEQ ID NO: 249 - protein, 11 aa, Artificial
  Humanized antibody sequence
WGPGTLVTVSS

SEQ ID NO: 250 - protein, 330 aa, Artificial; identical to SEQ ID NO: 50
  Humanized antibody sequence

SEQ ID NO: 251 - DNA, 1329 bp, Artificial
  Humanized antibody sequence
cagtcggtggaggagtccgggggtcgcctggtcacgcctgggacacccctgacactcacctgcaccgtctctggattctccctcagtagcgctgcaatgagctgggtccgccaggctccagggaaggggctggaatggatcggaattattgatgatagtggtaacacatactacgcgtcctgggcgaaagcccgattcaccatctccaaaacctcgtcgaccacggtggatctgaaaatgaccagtccgacaaccgaggacacggccacctatttctgtgccagagggggaggggagtttttcatctggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 252 - DNA, 339 bp, Artificial
  Humanized antibody sequence
cagtcggtggaggagtccgggggtcgcctggtcacgcctgggacacccctgacactcacctgcaccgtctctggattctccctcagtagcgctgcaatgagctgggtccgccaggctccagggaaggggctggaatggatcggaattattgatgatagtggtaacacatactacgcgtcctgggcgaaagcccgattcaccatctccaaaacctcgtcgaccacggtggatctgaaaatgaccagtccgacaaccgaggacacggccacctatttctgtgccagagggggaggggagtttttcatctggggcccgggcaccctcgtcaccgtctcgagc

SEQ ID NO: 253 - DNA, 87 bp, Oryctolagus cuniculus; identical to SEQ ID NO: 13

SEQ ID NO: 254 - DNA, 15 bp, Oryctolagus cuniculus
agcgctgcaatgagc

SEQ ID NO: 255 - DNA, 42 bp, Oryctolagus cuniculus; identical to SEQ ID NO: 15

SEQ ID NO: 256 - DNA, 48 bp, Oryctolagus cuniculus
attattgatgatagtggtaacacatactacgcgtcctgggcgaaagcc

SEQ ID NO: 257 - DNA, 93 bp, Oryctolagus cuniculus; identical to SEQ ID NO: 97

SEQ ID NO: 258 - DNA, 21 bp, Oryctolagus cuniculus
gggggaggggagtttttcatc

SEQ ID NO: 259 - DNA, 33 bp, Artificial; identical to SEQ ID NO: 139
  Humanized antibody sequence

SEQ ID NO: 260 - DNA, 990 bp, Artificial; identical to SEQ ID NO: 60
  Humanized antibody sequence

SEQ ID NO: 261 - protein, 217 aa, Artificial
  Humanized antibody sequence
DPVLTQTPSSVSAAVGGTVTINCQSSQSVYNNKWLSWYQQKPGQSPKFLIYQASNLASGVPSRFKGSGSGTQFTLTISDLECDDGATYYCAGGYRGNVCGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 262 - protein, 111 aa, Artificial
  Humanized antibody sequence
DPVLTQTPSSVSAAVGGTVTINCQSSQSVYNNKWLSWYQQKPGQSPKFLIYQASNLASGVPSRFKGSGSGTQFTLTISDLECDDGATYYCAGGYRGNVCGFGGGTEVVVKR

SEQ ID NO: 263 - protein, 23 aa, Oryctolagus cuniculus
DPVLTQTPSSVSAAVGGTVTINC

SEQ ID NO: 264 - protein, 13 aa, Oryctolagus cuniculus
QSSQSVYNNKWLS

SEQ ID NO: 265 - protein, 15 aa, Oryctolagus cuniculus
WYQQKPGQSPKFLIY

SEQ ID NO: 266 - protein, 7 aa, Oryctolagus cuniculus
QASNLAS

SEQ ID NO: 267 - protein, 32 aa, Oryctolagus cuniculus
GVPSRFKGSGSGTQFTLTISDLECDDGATYYC

SEQ ID NO: 268 - protein, 10 aa, Oryctolagus cuniculus
AGGYRGNVCG

SEQ ID NO: 269 - protein, 11 aa, Artificial
  Humanized antibody sequence
FGGGTEVVVKR

SEQ ID NO: 270 - protein, 106 aa, Artificial; identical to SEQ ID NO: 30
  Humanized antibody sequence

SEQ ID NO: 271 - DNA, 651 bp, Artificial
  Humanized antibody sequence
gaccctgtgctgacccagactccatcgtccgtgtctgcagctgtgggaggcacagtcaccatcaattgccagtccagtcagagtgtttataataacaagtggttatcctggtatcagcagaaaccaggacagtctcccaagttcctgatttaccaggcatccaatttggcatctggggtcccatcgcggttcaaaggcagtggatctgggacacagttcactctcaccatcagcgacctggagtgtgacgatggcgccacttattactgtgcaggcggctaccgtggtaatgtttgtggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 272 - DNA, 333 bp, Artificial
  Humanized antibody sequence
gaccctgtgctgacccagactccatcgtccgtgtctgcagctgtgggaggcacagtcaccatcaattgccagtccagtcagagtgtttataataacaagtggttatcctggtatcagcagaaaccaggacagtctcccaagttcctgatttaccaggcatccaatttggcatctggggtcccatcgcggttcaaaggcagtggatctgggacacagttcactctcaccatcagcgacctggagtgtgacgatggcgccacttattactgtgcaggcggctaccgtggtaatgtttgtggtttcggcggagggaccgaggtggtggtcaaacgt

SEQ ID NO: 273 - DNA, 69 bp, Oryctolagus cuniculus
gaccctgtgctgacccagactccatcgtccgtgtctgcagctgtgggaggcacagtcaccatcaattgc

SEQ ID NO: 274 - DNA, 39 bp, Oryctolagus cuniculus
cagtccagtcagagtgtttataataacaagtggttatcc

SEQ ID NO: 275 - DNA, 45 bp, Oryctolagus cuniculus
tggtatcagcagaaaccaggacagtctcccaagttcctgatttac

SEQ ID NO: 276 - DNA, 21 bp, Oryctolagus cuniculus
caggcatccaatttggcatct

SEQ ID NO: 277 - DNA, 96 bp, Oryctolagus cuniculus
ggggtcccatcgcggttcaaaggcagtggatctgggacacagttcactctcaccatcagcgacctggagtgtgacgatggcgccacttattactgt

SEQ ID NO: 278 - DNA, 30 bp, Oryctolagus cuniculus
gcaggcggctaccgtggtaatgtttgtggt

SEQ ID NO: 279 - DNA, 33 bp, Artificial; identical to SEQ ID NO: 39
  Humanized antibody sequence

SEQ ID NO: 280 - DNA, 318 bp, Artificial; identical to SEQ ID NO: 40
  Humanized antibody sequence

SEQ ID NO: 281 - protein, 443 aa, Artificial
  Humanized antibody sequence
QSVEESGGRLVTPGTPLTLTCTVSGFSLSSAAMNWVRQAPGKGLEWIGIFDPYSSTYYASWAKGRFTISKTSSTTVDLKMTSPTTEDTATYFCARGGGEFFIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 282 - protein, 113 aa, Artificial
  Humanized antibody sequence
QSVEESGGRLVTPGTPLTLTCTVSGFSLSSAAMNWVRQAPGKGLEWIGIFDPYSSTYYASWAKGRFTISKTSSTTVDLKMTSPTTEDTATYFCARGGGEFFIWGPGTLVTVSS

SEQ ID NO: 283 - protein, 29 aa, Oryctolagus cuniculus
QSVEESGGRLVTPGTPLTLTCTVSGFSLS

SEQ ID NO: 284 - protein, 5 aa, Oryctolagus cuniculus
SAAMN

SEQ ID NO: 285 - protein, 14 aa, Oryctolagus cuniculus
WVRQAPGKGLEWIG

SEQ ID NO: 286 - protein, 16 aa, Oryctolagus cuniculus
IFDPYSSTYYASWAKG

SEQ ID NO: 287 - protein, 31 aa, Oryctolagus cuniculus; identical to SEQ ID NO: 87

SEQ ID NO: 288 - protein, 7 aa, Oryctolagus cuniculus
GGGEFFI

SEQ ID NO: 289 - protein, 11 aa, Artificial
  Humanized antibody sequence
WGPGTLVTVSS

SEQ ID NO: 290 - protein, 330 aa, Artificial; identical to SEQ ID NO: 50
  Humanized antibody sequence

SEQ ID NO: 291 - DNA, 1329 bp, Artificial
  Humanized antibody sequence
cagtcagtggaggagtccgggggtcgcctggtcacgcctgggacacccctaacactcacctgcaccgtctctggattctccctcagtagcgctgcaatgaactgggtccgccaggctccagggaaggggctggaatggatcggtatttttgatccttatagtagtacatactacgcgtcctgggcgaaaggccgattcaccatctccaaaacctcgtcgaccacggtggatctgaaaatgaccagtccgacaaccgaggacacggccacctatttctgtgccagagggggaggggaatttttcatctggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 292 - DNA, 339 bp, Artificial
  Humanized antibody sequence
cagtcagtggaggagtccgggggtcgcctggtcacgcctgggacacccctaacactcacctgcaccgtctctggattctccctcagtagcgctgcaatgaactgggtccgccaggctccagggaaggggctggaatggatcggtatttttgatccttatagtagtacatactacgcgtcctgggcgaaaggccgattcaccatctccaaaacctcgtcgaccacggtggatctgaaaatgaccagtccgacaaccgaggacacggccacctatttctgtgccagagggggaggggaatttttcatctggggcccaggcaccctcgtcaccgtctcgagc

SEQ ID NO: 293 - DNA, 87 bp, Oryctolagus cuniculus
cagtcagtggaggagtccgggggtcgcctggtcacgcctgggacacccctaacactcacctgcaccgtctctggattctccctcagt

SEQ ID NO: 294 - DNA, 15 bp, Oryctolagus cuniculus
agcgctgcaatgaac

SEQ ID NO: 295 - DNA, 42 bp, Oryctolagus cuniculus
tgggtccgccaggctccagggaaggggctggaatggatcggt

SEQ ID NO: 296 - DNA, 48 bp, Oryctolagus cuniculus
atttttgatccttatagtagtacatactacgcgtcctgggcgaaaggc

SEQ ID NO: 297 - DNA, 93 bp, Oryctolagus cuniculus; identical to SEQ ID NO: 97

SEQ ID NO: 298 - DNA, 21 bp, Oryctolagus cuniculus
gggggaggggaatttttcatc

SEQ ID NO: 299 - DNA, 33 bp, Artificial
  Humanized antibody sequence
tggggcccaggcaccctcgtcaccgtctcgagc

SEQ ID NO: 300 - DNA, 990 bp, Artificial; identical to SEQ ID NO: 60
  Humanized antibody sequence

SEQ ID NO: 301 - protein, 217 aa, Artificial
  Humanized antibody sequence
AQVLTQTPSSVSAAVGGTVTINCQSSQSVYKNKYLSWYQQKVGQPPKFLIYQASNLASGVPSRFKGSGSGTQFTLTISDLECDDAATYYCAGGYSGNMVDFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 302 - protein, 111 aa, Artificial
  Humanized antibody sequence
AQVLTQTPSSVSAAVGGTVTINCQSSQSVYKNKYLSWYQQKVGQPPKFLIYQASNLASGVPSRFKGSGSGTQFTLTISDLECDDAATYYCAGGYSGNMVDFGGGTEVVVKR

SEQ ID NO: 303 - protein, 23 aa, Oryctolagus cuniculus
AQVLTQTPSSVSAAVGGTVTINC

SEQ ID NO: 304 - protein, 13 aa, Oryctolagus cuniculus
QSSQSVYKNKYLS

SEQ ID NO: 305 - protein, 15 aa, Oryctolagus cuniculus
WYQQKVGQPPKFLIY

SEQ ID NO: 306 - protein, 7 aa, Oryctolagus cuniculus
QASNLAS

SEQ ID NO: 307 - protein, 32 aa, Oryctolagus cuniculus; identical to SEQ ID NO: 107

SEQ ID NO: 308 - protein, 10 aa, Oryctolagus cuniculus
AGGYSGNMVD

SEQ ID NO: 309 - protein, 11 aa, Artificial
  Humanized antibody sequence
FGGGTEVVVKR

SEQ ID NO: 310 - protein, 106 aa, Artificial; identical to SEQ ID NO: 30
  Humanized antibody sequence

SEQ ID NO: 311 - DNA, 651 bp, Artificial
  Humanized antibody sequence
gcccaagtgctgacccagactccatcgtccgtgtctgcagctgtgggaggcacagtcaccatcaattgccagtccagtcagagtgtttataagaataagtacttatcctggtatcagcagaaagtagggcagcctcccaagttcctgatctaccaggcatccaatttggcatctggggtcccatcgcggttcaaaggcagtggatctgggacacagttcactctcaccatcagcgacctggagtgtgacgatgccgccacttattactgtgcaggcggttatagtggtaatatggttgatttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 312 - DNA, 333 bp, Artificial
  Humanized antibody sequence
gcccaagtgctgacccagactccatcgtccgtgtctgcagctgtgggaggcacagtcaccatcaattgccagtccagtcagagtgtttataagaataagtacttatcctggtatcagcagaaagtagggcagcctcccaagttcctgatctaccaggcatccaatttggcatctggggtcccatcgcggttcaaaggcagtggatctgggacacagttcactctcaccatcagcgacctggagtgtgacgatgccgccacttattactgtgcaggcggttatagtggtaatatggttgatttcggcggagggaccgaggtggtggtcaaacgt

SEQ ID NO: 313 - DNA, 69 bp, Oryctolagus cuniculus
gcccaagtgctgacccagactccatcgtccgtgtctgcagctgtgggaggcacagtcaccatcaattgc

SEQ ID NO: 314 - DNA, 39 bp, Oryctolagus cuniculus
cagtccagtcagagtgtttataagaataagtacttatcc

SEQ ID NO: 315 - DNA, 45 bp, Oryctolagus cuniculus
tggtatcagcagaaagtagggcagcctcccaagttcctgatctac

SEQ ID NO: 316 - DNA, 21 bp, Oryctolagus cuniculus
caggcatccaatttggcatct

SEQ ID NO: 317 - DNA, 96 bp, Oryctolagus cuniculus; identical to SEQ ID NO: 117

SEQ ID NO: 318 - DNA, 30 bp, Oryctolagus cuniculus
gcaggcggttatagtggtaatatggttgat

SEQ ID NO: 319 - DNA, 33 bp, Artificial; identical to SEQ ID NO: 39
  Humanized antibody sequence

SEQ ID NO: 320 - DNA, 318 bp, Artificial; identical to SEQ ID NO: 40
  Humanized antibody sequence

SEQ ID NO: 321 - protein, 443 aa, Artificial
  Humanized antibody sequence
QSVEESGGRLVTPGTPLTLTCTVSGFSLSSAALSWVRQAPGKGLEWIGIIDKGVMSYYASWAKGRFTISKTSSTTVDLKVTSPTTEDTATYFCARGGGEFFIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 322 - protein, 113 aa, Artificial
  Humanized antibody sequence
QSVEESGGRLVTPGTPLTLTCTVSGFSLSSAALSWVRQAPGKGLEWIGIIDKGVMSYYASWAKGRFTISKTSSTTVDLKVTSPTTEDTATYFCARGGGEFFIWGQGTLVTVSS

SEQ ID NO: 323 - protein, 29 aa, Oryctolagus cuniculus
QSVEESGGRLVTPGTPLTLTCTVSGFSLS

SEQ ID NO: 324 - protein, 5 aa, Oryctolagus cuniculus
SAALS

SEQ ID NO: 325 - protein, 14 aa, Oryctolagus cuniculus
WVRQAPGKGLEWIG

SEQ ID NO: 326 - protein, 16 aa, Oryctolagus cuniculus
IIDKGVMSYYASWAKG

SEQ ID NO: 327 - protein, 31 aa, Oryctolagus cuniculus
RFTISKTSSTTVDLKVTSPTTEDTATYFCAR

SEQ ID NO: 328 - protein, 7 aa, Oryctolagus cuniculus
GGGEFFI

SEQ ID NO: 329 - protein, 11 aa, Artificial
  Humanized antibody sequence
WGQGTLVTVSS

SEQ ID NO: 330 - protein, 330 aa, Artificial; identical to SEQ ID NO: 50
  Humanized antibody sequence

SEQ ID NO: 331 - DNA, 1329 bp, Artificial
  Humanized antibody sequence
cagtcggtggaggagtccgggggtcgcctggtcacgcctgggacacccctgacactcacctgcaccgtctctggattctccctcagtagcgctgcattgagctgggtccgccaggctccagggaaggggctggaatggatcggaattattgataagggtgttatgtcttactacgcgtcctgggcgaaaggccgattcaccatctccaaaacctcgtcgaccacggtggatctaaaagtgaccagtccgacaaccgaggacacggccacctatttctgtgccagaggggggggggaatttttcatctggggccagggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 332 - DNA, 339 bp, Artificial
  Humanized antibody sequence
cagtcggtggaggagtccgggggtcgcctggtcacgcctgggacacccctgacactcacctgcaccgtctctggattctccctcagtagcgctgcattgagctgggtccgccaggctccagggaaggggctggaatggatcggaattattgataagggtgttatgtcttactacgcgtcctgggcgaaaggccgattcaccatctccaaaacctcgtcgaccacggtggatctaaaagtgaccagtccgacaaccgaggacacggccacctatttctgtgccagaggggggggggaatttttcatctggggccagggcaccctcgtcaccgtctcgagc

SEQ ID NO: 333 - DNA, 87 bp, Oryctolagus cuniculus; identical to SEQ ID NO: 13

SEQ ID NO: 334 - DNA, 15 bp, Oryctolagus cuniculus
agcgctgcattgagc

SEQ ID NO: 335 - DNA, 42 bp, Oryctolagus cuniculus; identical to SEQ ID NO: 15

SEQ ID NO: 336 - DNA, 48 bp, Oryctolagus cuniculus
attattgataagggtgttatgtcttactacgcgtcctgggcgaaaggc

SEQ ID NO: 337 - DNA, 93 bp, Oryctolagus cuniculus
cgattcaccatctccaaaacctcgtcgaccacggtggatctaaaagtgaccagtccgacaaccgaggacacggccacctatttctgtgccaga

SEQ ID NO: 338 - DNA, 21 bp, Oryctolagus cuniculus
ggggggggggaatttttcatc

SEQ ID NO: 339 - DNA, 33 bp, Artificial; identical to SEQ ID NO: 219
  Humanized antibody sequence

SEQ ID NO: 340 - DNA, 990 bp, Artificial; identical to SEQ ID NO: 60
  Humanized antibody sequence

SEQ ID NO: 341 - protein, 217 aa, Artificial
  Humanized antibody sequence
AQVLTQTPSSVSAAVGGTVTINCQSSKSVYNNNWLSWYQQKPGQPPKFLIYQASNLASGVPSRFKGSGSGTQFTLTISDLECDDAATYYCAGGYSGNIVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - protein, 111 aa, Artificial
  Humanized antibody sequence
AQVLTQTPSSVSAAVGGTVTINCQSSKSVYNNNWLSWYQQKPGQPPKFLIYQASNLASGVPSRFKGSGSGTQFTLTISDLECDDAATYYCAGGYSGNIVGFGGGTEVVVKR

SEQ ID NO: 343 - protein, 23 aa, Oryctolagus cuniculus
AQVLTQTPSSVSAAVGGTVTINC

SEQ ID NO: 344 - protein, 13 aa, Oryctolagus cuniculus
QSSKSVYNNNWLS

SEQ ID NO: 345 - protein, 15 aa, Oryctolagus cuniculus
WYQQKPGQPPKFLIY

SEQ ID NO: 346 - protein, 7 aa, Oryctolagus cuniculus
QASNLAS

SEQ ID NO: 347 - protein, 32 aa, Oryctolagus cuniculus; identical to SEQ ID NO: 107

SEQ ID NO: 348 - protein, 10 aa, Oryctolagus cuniculus
AGGYSGNIVG

SEQ ID NO: 349 - protein, 11 aa, Artificial
  Humanized antibody sequence
FGGGTEVVVKR

SEQ ID NO: 350 - protein, 106 aa, Artificial; identical to SEQ ID NO: 30
  Humanized antibody sequence

SEQ ID NO: 351 - DNA, 651 bp, Artificial
  Humanized antibody sequence
gcgcaagtgctgacccagactccatcgtccgtgtctgcagctgtgggaggcacagtcaccatcaattgccagtccagtaagagtgtttataacaacaattggttatcctggtatcaacagaaaccagggcagcctcccaagttcctgatctaccaggcatccaatttggcatctggggtcccgtcgcggttcaaaggcagtggatctgggacacagttcactctcaccatcagcgacctcgagtgtgacgatgccgccacttattactgtgcaggcggttatagtggtaatattgttggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 352 - DNA, 333 bp, Artificial
  Humanized antibody sequence
gcgcaagtgctgacccagactccatcgtccgtgtctgcagctgtgggaggcacagtcaccatcaattgccagtccagtaagagtgtttataacaacaattggttatcctggtatcaacagaaaccagggcagcctcccaagttcctgatctaccaggcatccaatttggcatctggggtcccgtcgcggttcaaaggcagtggatctgggacacagttcactctcaccatcagcgacctcgagtgtgacgatgccgccacttattactgtgcaggcggttatagtggtaatattgttggtttcggcggagggaccgaggtggtggtcaaacgt

SEQ ID NO: 353 - DNA, 69 bp, Oryctolagus cuniculus; identical to SEQ ID NO: 153

SEQ ID NO: 354 - DNA, 39 bp, Oryctolagus cuniculus
cagtccagtaagagtgtttataacaacaattggttatcc

SEQ ID NO: 355 - DNA, 45 bp, Oryctolagus cuniculus
tggtatcaacagaaaccagggcagcctcccaagttcctgatctac

SEQ ID NO: 356 - DNA, 21 bp, Oryctolagus cuniculus
caggcatccaatttggcatct

SEQ ID NO: 357 - DNA, 96 bp, Oryctolagus cuniculus
ggggtcccgtcgcggttcaaaggcagtggatctgggacacagttcactctcaccatcagcgacctcgagtgtgacgatgccgccacttattactgt

SEQ ID NO: 358 - DNA, 30 bp, Oryctolagus cuniculus
gcaggcggttatagtggtaatattgttggt

SEQ ID NO: 359 - DNA, 33 bp, Artificial; identical to SEQ ID NO: 39
  Humanized antibody sequence

SEQ ID NO: 360 - DNA, 318 bp, Artificial; identical to SEQ ID NO: 40
  Humanized antibody sequence

SEQ ID NO: 361 - protein, 443 aa, Artificial
  Humanized antibody sequence
QSVEASGGRLVTPGTPLTLTCTVSGFSLSSATMNWVRQAPGKGLEWIGLIGGNDERYYASWAKGRFTISKTSSTTVDLKMTSPTTEDTATYFCARGGGEFFIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 362 - protein, 113 aa, Artificial
  Humanized antibody sequence
QSVEASGGRLVTPGTPLTLTCTVSGFSLSSATMNWVRQAPGKGLEWIGLIGGNDERYYASWAKGRFTISKTSSTTVDLKMTSPTTEDTATYFCARGGGEFFIWGPGTLVTVSS

SEQ ID NO: 363 - protein, 29 aa, Oryctolagus cuniculus
QSVEASGGRLVTPGTPLTLTCTVSGFSLS

SEQ ID NO: 364 - protein, 5 aa, Oryctolagus cuniculus
SATMN

SEQ ID NO: 365 - protein, 14 aa, Oryctolagus cuniculus
WVRQAPGKGLEWIG

SEQ ID NO: 366 - protein, 16 aa, Oryctolagus cuniculus
LIGGNDERYYASWAKG

SEQ ID NO: 367 - protein, 31 aa, Oryctolagus cuniculus; identical to SEQ ID NO: 87

SEQ ID NO: 368 - protein, 7 aa, Oryctolagus cuniculus
GGGEFFI

SEQ ID NO: 369 - protein, 11 aa, Artificial
  Humanized antibody sequence
WGPGTLVTVSS

SEQ ID NO: 370 - protein, 330 aa, Artificial; identical to SEQ ID NO: 50
  Humanized antibody sequence

SEQ ID NO: 371 - DNA, 1329 bp, Artificial
  Humanized antibody sequence
cagtcggtggaggcgtccgggggtcgcctggtcacgcctgggacacccctgacactcacctgcaccgtctctggattctccctcagtagcgctacaatgaactgggtccgccaggctccagggaaggggctggaatggatcgggcttattggcggtaatgacgaaagatactacgcgtcctgggcgaaaggccgattcaccatctccaaaacctcgtcgaccacggtggatctgaaaatgaccagtccgacaaccgaggacacggccacctatttctgtgccagaggggggggggaatttttcatctggggcccgggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 372 - DNA, 339 bp, Artificial
  Humanized antibody sequence
cagtcggtggaggcgtccgggggtcgcctggtcacgcctgggacacccctgacactcacctgcaccgtctctggattctccctcagtagcgctacaatgaactgggtccgccaggctccagggaaggggctggaatggatcgggcttattggcggtaatgacgaaagatactacgcgtcctgggcgaaaggccgattcaccatctccaaaacctcgtcgaccacggtggatctgaaaatgaccagtccgacaaccgaggacacggccacctatttctgtgccagaggggggggggaatttttcatctggggcccgggcaccctggtcaccgtctcgagc

SEQ ID NO: 373 - DNA, 87 bp, Oryctolagus cuniculus; identical to SEQ ID NO: 173

SEQ ID NO: 374 - DNA, 15 bp, Oryctolagus cuniculus
agcgctacaatgaac

SEQ ID NO: 375 - DNA, 42 bp, Oryctolagus cuniculus
tgggtccgccaggctccagggaaggggctggaatggatcggg

SEQ ID NO: 376 - DNA, 48 bp, Oryctolagus cuniculus
cttattggcggtaatgacgaaagatactacgcgtcctgggcgaaaggc

SEQ ID NO: 377 - DNA, 93 bp, Oryctolagus cuniculus; identical to SEQ ID NO: 97

SEQ ID NO: 378 - DNA, 21 bp, Oryctolagus cuniculus
ggggggggggaatttttcatc

SEQ ID NO: 379 - DNA, 33 bp, Artificial
  Humanized antibody sequence
tggggcccgggcaccctggtcaccgtctcgagc

SEQ ID NO: 380 - DNA, 990 bp, Artificial; identical to SEQ ID NO: 60
  Humanized antibody sequence

SEQ ID NO: 381 - protein, 217 aa, Artificial
  Humanized antibody sequence
AQVLTQTPSSVSAAVGGTVTINCQSSESVYTNDRLSWYQQKPGQPPKLLIYEASKLASGVPPRFSGSGSGTQFTLTISDLECDDAATYYCAGAYSTSIHGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 382 - protein, 111 aa, Artificial
  Humanized antibody sequence
AQVLTQTPSSVSAAVGGTVTINCQSSESVYTNDRLSWYQQKPGQPPKLLIYEASKLASGVPPRFSGSGSGTQFTLTISDLECDDAATYYCAGAYSTSIHGFGGGTEVVVKR

SEQ ID NO: 383 - protein, 23 aa, Oryctolagus cuniculus
AQVLTQTPSSVSAAVGGTVTINC

SEQ ID NO: 384 - protein, 13 aa, Oryctolagus cuniculus
QSSESVYTNDRLS

SEQ ID NO: 385 - protein, 15 aa, Oryctolagus cuniculus
WYQQKPGQPPKLLIY

SEQ ID NO: 386 - protein, 7 aa, Oryctolagus cuniculus
EASKLAS

SEQ ID NO: 387 - protein, 32 aa, Oryctolagus cuniculus
GVPPRFSGSGSGTQFTLTISDLECDDAATYYC

SEQ ID NO: 388 - protein, 10 aa, Oryctolagus cuniculus
AGAYSTSIHG

SEQ ID NO: 389 - protein, 11 aa, Artificial
  Humanized antibody sequence
FGGGTEVVVKR

SEQ ID NO: 390 - protein, 106 aa, Artificial; identical to SEQ ID NO: 30
  Humanized antibody sequence

SEQ ID NO: 391 - DNA, 651 bp, Artificial
  Humanized antibody sequence
gcgcaagtgctgacccagactccatcgtccgtgtctgcagctgtgggaggcacagtcaccatcaattgccagtccagtgagagtgtttatactaacgaccgcttatcctggtatcagcagaaaccagggcagcctcccaagctcctgatctacgaagcatccaagctggcatctggggtcccaccgcggttcagcggcagtggatctgggacacagttcactctcaccatcagcgacctggagtgtgacgatgccgccacttattactgtgcaggcgcttatagtactagtatccatggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 392 - DNA, 333 bp, Artificial
  Humanized antibody sequence
gcgcaagtgctgacccagactccatcgtccgtgtctgcagctgtgggaggcacagtcaccatcaattgccagtccagtgagagtgtttatactaacgaccgcttatcctggtatcagcagaaaccagggcagcctcccaagctcctgatctacgaagcatccaagctggcatctggggtcccaccgcggttcagcggcagtggatctgggacacagttcactctcaccatcagcgacctggagtgtgacgatgccgccacttattactgtgcaggcgcttatagtactagtatccatggtttcggcggagggaccgaggtggtggtcaaacgt

SEQ ID NO: 393 - DNA, 69 bp, Oryctolagus cuniculus; identical to SEQ ID NO: 153

SEQ ID NO: 394 - DNA, 39 bp, Oryctolagus cuniculus
cagtccagtgagagtgtttatactaacgaccgcttatcc

SEQ ID NO: 395 - DNA, 45 bp, Oryctolagus cuniculus
tggtatcagcagaaaccagggcagcctcccaagctcctgatctac

SEQ ID NO: 396 - DNA, 21 bp, Oryctolagus cuniculus
gaagcatccaagctggcatct

SEQ ID NO: 397 - DNA, 96 bp, Oryctolagus cuniculus
ggggtcccaccgcggttcagcggcagtggatctgggacacagttcactctcaccatcagcgacctggagtgtgacgatgccgccacttattactgt

SEQ ID NO: 398 - DNA, 30 bp, Oryctolagus cuniculus
gcaggcgcttatagtactagtatccatggt

SEQ ID NO: 399 - DNA, 33 bp, Artificial; identical to SEQ ID NO: 39
  Humanized antibody sequence

SEQ ID NO: 400 - DNA, 318 bp, Artificial; identical to SEQ ID NO: 40
  Humanized antibody sequence

SEQ ID NO: 401-480 - skipped (80 entries)

SEQ ID NO: 481 - protein, 445 aa, Artificial
  Humanized antibody sequence
QSVEESGGRLVTPGTPLTLTCTVSGFSLSSYAMIWVRQAPGKGLEWIGIIYDNGDTYYASWAKGRFTISKTSTTVYLKIASPTTEDTATYFCAREPGSTTQNDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 482 - protein, 115 aa, Artificial
  Humanized antibody sequence
QSVEESGGRLVTPGTPLTLTCTVSGFSLSSYAMIWVRQAPGKGLEWIGIIYDNGDTYYASWAKGRFTISKTSTTVYLKIASPTTEDTATYFCAREPGSTTQNDLWGQGTLVTVSS

SEQ ID NO: 483 - protein, 29 aa, Oryctolagus cuniculus
QSVEESGGRLVTPGTPLTLTCTVSGFSLS

SEQ ID NO: 484 - protein, 5 aa, Oryctolagus cuniculus
SYAMI

SEQ ID NO: 485 - protein, 14 aa, Oryctolagus cuniculus
WVRQAPGKGLEWIG

SEQ ID NO: 486 - protein, 16 aa, Oryctolagus cuniculus
IIYDNGDTYYASWAKG

SEQ ID NO: 487 - protein, 30 aa, Oryctolagus cuniculus
RFTISKTSTTVYLKIASPTTEDTATYFCAR

SEQ ID NO: 488 - protein, 10 aa, Oryctolagus cuniculus
EPGSTTQNDL

SEQ ID NO: 489 - protein, 11 aa, Artificial
  Humanized antibody sequence
WGQGTLVTVSS

SEQ ID NO: 490 - protein, 330 aa, Artificial; identical to SEQ ID NO: 10
  Humanized antibody sequence

SEQ ID NO: 491 - DNA, 1335 bp, Artificial
  Humanized antibody sequence
cagtcggtggaggagtccgggggtcgcctggtcacgcctgggacacccctgacactcacctgcacagtctctggattctccctcagtagctatgcgatgatctgggtccgccaggctccagggaaggggctggaatggatcggaatcatttatgataatggtgacacatactacgcgagctgggcgaaaggccggttcaccatctccaaaacctcgaccacggtgtatctgaagatcgccagtccgacaaccgaggacacggccacctacttctgtgccagagagcctggtagtactactcagaatgacttgtggggccaagggaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 492 - DNA, 345 bp, Artificial
  Humanized antibody sequence
cagtcggtggaggagtccgggggtcgcctggtcacgcctgggacacccctgacactcacctgcacagtctctggattctccctcagtagctatgcgatgatctgggtccgccaggctccagggaaggggctggaatggatcggaatcatttatgataatggtgacacatactacgcgagctgggcgaaaggccggttcaccatctccaaaacctcgaccacggtgtatctgaagatcgccagtccgacaaccgaggacacggccacctacttctgtgccagagagcctggtagtactactcagaatgacttgtggggccaagggaccctggtcaccgtctcgagc

SEQ ID NO: 493 - DNA, 87 bp, Oryctolagus cuniculus
cagtcggtggaggagtccgggggtcgcctggtcacgcctgggacacccctgacactcacctgcacagtctctggattctccctcagt

SEQ ID NO: 494 - DNA, 15 bp, Oryctolagus cuniculus
agctatgcgatgatc

SEQ ID NO: 495 - DNA, 42 bp, Oryctolagus cuniculus; identical to SEQ ID NO: 15

SEQ ID NO: 496 - DNA, 48 bp, Oryctolagus cuniculus
atcatttatgataatggtgacacatactacgcgagctgggcgaaaggc

SEQ ID NO: 497 - DNA, 90 bp, Oryctolagus cuniculus
cggttcaccatctccaaaacctcgaccacggtgtatctgaagatcgccagtccgacaaccgaggacacggccacctacttctgtgccaga

SEQ ID NO: 498 - DNA, 30 bp, Oryctolagus cuniculus
gagcctggtagtactactcagaatgacttg

SEQ ID NO: 499 - DNA, 33 bp, Artificial; identical to SEQ ID NO: 99
  Humanized antibody sequence

SEQ ID NO: 500 - DNA, 990 bp, Artificial; identical to SEQ ID NO: 20
  Humanized antibody sequence

SEQ ID NO: 501 - protein, 217 aa, Artificial
  Humanized antibody sequence
DVVMTQTPASVSEPVGGTVTIKCQASENIYNSLLWYQQKPGQPPKLLIYRASTLASGVSSRFKGSGSGTEFTLTISDLECADAATYYCQNYYNIWTNGAAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 502 - protein, 111 aa, Artificial
  Humanized antibody sequence
DVVMTQTPASVSEPVGGTVTIKCQASENIYNSLLWYQQKPGQPPKLLIYRASTLASGVSSRFKGSGSGTEFTLTISDLECADAATYYCQNYYNIWTNGAAFGGGTEVVVKR

SEQ ID NO: 503 - protein, 23 aa, Oryctolagus cuniculus
DVVMTQTPASVSEPVGGTVTIKC

SEQ ID NO: 504 - protein, 11 aa, Oryctolagus cuniculus
QASENIYNSLL

SEQ ID NO: 505 - protein, 15 aa, Oryctolagus cuniculus
WYQQKPGQPPKLLIY

SEQ ID NO: 506 - protein, 7 aa, Oryctolagus cuniculus
RASTLAS

SEQ ID NO: 507 - protein, 32 aa, Oryctolagus cuniculus
GVSSRFKGSGSGTEFTLTISDLECADAATYYC

SEQ ID NO: 508 - protein, 12 aa, Oryctolagus cuniculus
QNYYNIWTNGAA

SEQ ID NO: 509 - protein, 11 aa, Artificial
  Humanized antibody sequence
FGGGTEVVVKR

SEQ ID NO: 510 - protein, 106 aa, Artificial; identical to SEQ ID NO: 30
  Humanized antibody sequence

SEQ ID NO: 511 - DNA, 651 bp, Artificial
  Humanized antibody sequence
gatgttgtgatgacccagactccagcctccgtgtctgaacctgtgggaggcacagtcaccatcaagtgccaggccagtgagaacatttacaactctttactctggtatcagcagaaaccagggcagcctcccaagctcctgatctatagggcatccactctggcatctggggtctcatcgcggttcaaaggcagtggatctgggacagagttcactctcaccatcagcgacctggagtgtgccgatgctgccacttactactgtcaaaactattataatatatggactaatggtgctgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 512 - DNA, 333 bp, Artificial
  Humanized antibody sequence
gatgttgtgatgacccagactccagcctccgtgtctgaacctgtgggaggcacagtcaccatcaagtgccaggccagtgagaacatttacaactctttactctggtatcagcagaaaccagggcagcctcccaagctcctgatctatagggcatccactctggcatctggggtctcatcgcggttcaaaggcagtggatctgggacagagttcactctcaccatcagcgacctggagtgtgccgatgctgccacttactactgtcaaaactattataatatatggactaatggtgctgctttcggcggagggaccgaggtggtggtcaaacgt

SEQ ID NO: 513 - DNA, 69 bp, Oryctolagus cuniculus
gatgttgtgatgacccagactccagcctccgtgtctgaacctgtgggaggcacagtcaccatcaagtgc

SEQ ID NO: 514 - DNA, 33 bp, Oryctolagus cuniculus
caggccagtgagaacatttacaactctttactc

SEQ ID NO: 515 - DNA, 45 bp, Oryctolagus cuniculus
tggtatcagcagaaaccagggcagcctcccaagctcctgatctat

SEQ ID NO: 516 - DNA, 21 bp, Oryctolagus cuniculus
agggcatccactctggcatct

SEQ ID NO: 517 - DNA, 96 bp, Oryctolagus cuniculus
ggggtctcatcgcggttcaaaggcagtggatctgggacagagttcactctcaccatcagcgacctggagtgtgccgatgctgccacttactactgt

SEQ ID NO: 518 - DNA, 36 bp, Oryctolagus cuniculus
caaaactattataatatatggactaatggtgctgct

SEQ ID NO: 519 - DNA, 33 bp, Artificial; identical to SEQ ID NO: 39
  Humanized antibody sequence

SEQ ID NO: 520 - DNA, 318 bp, Artificial; identical to SEQ ID NO: 40
  Humanized antibody sequence

SEQ ID NO: 521 - protein, 441 aa, Artificial
  Humanized antibody sequence
QSVEESGGRLVTPGTPLTLTCTASGIDLSGYAMGWVRQAPGKGLEWIGDISTYGTTDYASWVNGRFTISRTSTTVTLKMTSLTTEDTATYFCARDYWLSLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 111 aa, Artificial
  Humanized antibody sequence
QSVEESGGRLVTPGTPLTLTCTASGIDLSGYAMGWVRQAPGKGLEWIGDISTYGTTDYASWVNGRFTISRTSTTVTLKMTSLTTEDTATYFCARDYWLSLWGPGTLVTVSS

SEQ ID NO: 523 - protein, 29 aa, Oryctolagus cuniculus
QSVEESGGRLVTPGTPLTLTCTASGIDLS

SEQ ID NO: 524 - protein, 5 aa, Oryctolagus cuniculus
GYAMG

SEQ ID NO: 525 - protein, 14 aa, Oryctolagus cuniculus
WVRQAPGKGLEWIG

SEQ ID NO: 526 - protein, 16 aa, Oryctolagus cuniculus
DISTYGTTDYASWVNG

SEQ ID NO: 527 - protein, 30 aa, Oryctolagus cuniculus
RFTISRTSTTVTLKMTSLTTEDTATYFCAR

SEQ ID NO: 528 - protein, 6 aa, Oryctolagus cuniculus
DYWLSL

SEQ ID NO: 529 - protein, 11 aa, Artificial
  Humanized antibody sequence
WGPGTLVTVSS

SEQ ID NO: 530 - protein, 330 aa, Artificial; identical to SEQ ID NO: 10
  Humanized antibody sequence

SEQ ID NO: 531 - DNA, 1323 bp, Artificial
  Humanized antibody sequence
cagtcggtggaggagtccgggggtcgcctggtaacgcctgggacacccctgacactcacctgcacagcctctggaatcgacctcagtggctatgcaatgggctgggtccgccaggctccagggaaggggctggaatggatcggagacattagtacctatggtaccacagactacgcgagctgggtgaatggccgattcaccatctccagaacctcgaccacggtgactctgaaaatgaccagtctgacaaccgaggacacggccacctatttctgtgccagagactattggttgagcttgtggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 532 - DNA, 333 bp, Artificial
  Humanized antibody sequence
cagtcggtggaggagtccgggggtcgcctggtaacgcctgggacacccctgacactcacctgcacagcctctggaatcgacctcagtggctatgcaatgggctgggtccgccaggctccagggaaggggctggaatggatcggagacattagtacctatggtaccacagactacgcgagctgggtgaatggccgattcaccatctccagaacctcgaccacggtgactctgaaaatgaccagtctgacaaccgaggacacggccacctatttctgtgccagagactattggttgagcttgtggggcccgggcaccctcgtcaccgtctcgagc

SEQ ID NO: 533 - DNA, 87 bp, Oryctolagus cuniculus
cagtcggtggaggagtccgggggtcgcctggtaacgcctgggacacccctgacactcacctgcacagcctctggaatcgacctcagt

SEQ ID NO: 534 - DNA, 15 bp, Oryctolagus cuniculus
ggctatgcaatgggc

SEQ ID NO: 535 - DNA, 42 bp, Oryctolagus cuniculus; identical to SEQ ID NO: 15

SEQ ID NO: 536 - DNA, 48 bp, Oryctolagus cuniculus
gacattagtacctatggtaccacagactacgcgagctgggtgaatggc

SEQ ID NO: 537 - DNA, 90 bp, Oryctolagus cuniculus
cgattcaccatctccagaacctcgaccacggtgactctgaaaatgaccagtctgacaaccgaggacacggccacctatttctgtgccaga

SEQ ID NO: 538 - DNA, 18 bp, Oryctolagus cuniculus
gactattggttgagcttg

SEQ ID NO: 539 - DNA, 33 bp, Artificial; identical to SEQ ID NO: 139
  Humanized antibody sequence

SEQ ID NO: 540 - DNA, 990 bp, Artificial; identical to SEQ ID NO: 20
  Humanized antibody sequence

SEQ ID NO: 541 - protein, 218 aa, Artificial
  Humanized antibody sequence
AAVLTQTPSPVSAAVGGTVTIKCQSSQSVYDNNALAWYQQKPGQPPKLLIYAASTLASGVPSRFKGSGSGTQFTLTINGVQCDDAATYYCLGGYDDPADNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 112 aa, Artificial
  Humanized antibody sequence
AAVLTQTPSPVSAAVGGTVTIKCQSSQSVYDNNALAWYQQKPGQPPKLLIYAASTLASGVPSRFKGSGSGTQFTLTINGVQCDDAATYYCLGGYDDPADNAFGGGTEVVVKR

SEQ ID NO: 543 - protein, 23 aa, Oryctolagus cuniculus
AAVLTQTPSPVSAAVGGTVTIKC

SEQ ID NO: 544 - protein, 13 aa, Oryctolagus cuniculus
QSSQSVYDNNALA

SEQ ID NO: 545 - protein, 15 aa, Oryctolagus cuniculus
WYQQKPGQPPKLLIY

SEQ ID NO: 546 - protein, 7 aa, Oryctolagus cuniculus
AASTLAS

SEQ ID NO: 547 - protein, 32 aa, Oryctolagus cuniculus
GVPSRFKGSGSGTQFTLTINGVQCDDAATYYC

SEQ ID NO: 548 - protein, 11 aa, Oryctolagus cuniculus
LGGYDDPADNA

SEQ ID NO: 549 - protein, 11 aa, Artificial
  Humanized antibody sequence
FGGGTEVVVKR

SEQ ID NO: 550 - protein, 106 aa, Artificial; identical to SEQ ID NO: 30
  Humanized antibody sequence

SEQ ID NO: 551 - DNA, 654 bp, Artificial
  Humanized antibody sequence
gcagccgtgctgacccagacaccatcgcccgtgtctgcagctgtgggaggcacagtcaccatcaagtgccagtccagtcagagtgtttatgataacaatgctttagcctggtatcagcagaaaccagggcagcctcccaagctcctgatctatgctgcatccactctggcatctggggtcccatcgcggttcaaaggcagtggatctgggacacagttcactctcaccatcaacggcgtgcagtgtgacgatgctgccacttactactgtctaggcggttatgatgatcctgctgataatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 552 - DNA, 336 bp, Artificial
  Humanized antibody sequence
gcagccgtgctgacccagacaccatcgcccgtgtctgcagctgtgggaggcacagtcaccatcaagtgccagtccagtcagagtgtttatgataacaatgctttagcctggtatcagcagaaaccagggcagcctcccaagctcctgatctatgctgcatccactctggcatctggggtcccatcgcggttcaaaggcagtggatctgggacacagttcactctcaccatcaacggcgtgcagtgtgacgatgctgccacttactactgtctaggcggttatgatgatcctgctgataatgctttcggcggagggaccgaggtggtggtcaaacgt

SEQ ID NO: 553 - DNA, 69 bp, Oryctolagus cuniculus
gcagccgtgctgacccagacaccatcgcccgtgtctgcagctgtgggaggcacagtcaccatcaagtgc

SEQ ID NO: 554 - DNA, 39 bp, Oryctolagus cuniculus
cagtccagtcagagtgtttatgataacaatgctttagcc

SEQ ID NO: 555 - DNA, 45 bp, Oryctolagus cuniculus; identical to SEQ ID NO: 515

SEQ ID NO: 556 - DNA, 21 bp, Oryctolagus cuniculus
gctgcatccactctggcatct

SEQ ID NO: 557 - DNA, 96 bp, Oryctolagus cuniculus
ggggtcccatcgcggttcaaaggcagtggatctgggacacagttcactctcaccatcaacggcgtgcagtgtgacgatgctgccacttactactgt

SEQ ID NO: 558 - DNA, 33 bp, Oryctolagus cuniculus
ctaggcggttatgatgatcctgctgataatgct

SEQ ID NO: 559 - DNA, 33 bp, Artificial; identical to SEQ ID NO: 39
  Humanized antibody sequence

SEQ ID NO: 560 - DNA, 318 bp, Artificial; identical to SEQ ID NO: 40
  Humanized antibody sequence

SEQ ID NO: 561 - protein, 441 aa, Artificial
  Humanized antibody sequence
QSVEESGGRLVTPGTPLTLTCTASGFSLSRYAMGWVRQAPGKGLEWIGDISTYGTTDYASWVNGRFTISRTSTTVTLKMTSLTTEDTATYFCARDYWLSLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 562 - protein, 111 aa, Artificial
  Humanized antibody sequence
QSVEESGGRLVTPGTPLTLTCTASGFSLSRYAMGWVRQAPGKGLEWIGDISTYGTTDYASWVNGRFTISRTSTTVTLKMTSLTTEDTATYFCARDYWLSLWGQGTLVTVSS

SEQ ID NO: 563 - protein, 29 aa, Oryctolagus cuniculus
QSVEESGGRLVTPGTPLTLTCTASGFSLS

SEQ ID NO: 564 - protein, 5 aa, Oryctolagus cuniculus
RYAMG

SEQ ID NO: 565 - protein, 14 aa, Oryctolagus cuniculus
WVRQAPGKGLEWIG

SEQ ID NO: 566 - protein, 16 aa, Oryctolagus cuniculus
DISTYGTTDYASWVNG

SEQ ID NO: 567 - protein, 30 aa, Oryctolagus cuniculus; identical to SEQ ID NO: 527

SEQ ID NO: 568 - protein, 6 aa, Oryctolagus cuniculus
DYWLSL

SEQ ID NO: 569 - protein, 11 aa, Artificial
  Humanized antibody sequence
WGQGTLVTVSS

SEQ ID NO: 570 - protein, 330 aa, Artificial; identical to SEQ ID NO: 10
  Humanized antibody sequence

SEQ ID NO: 571 - DNA, 1323 bp, Artificial
  Humanized antibody sequence
cagtcggtggaggagtctgggggtcgcctggtcacgcctgggacacccctgacactcacctgcacagcctctggattctccctcagtagatatgcaatgggctgggtccgccaggctccagggaaggggctggaatggatcggagacattagtacttatggtaccacagactacgcgagctgggtgaatggccgattcaccatctccagaacctcgaccacggtgactctgaaaatgaccagtctgacaaccgaggacacggccacctatttctgtgccagagactattggttgagcttgtggggccaaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 572 - DNA, 333 bp, Artificial
  Humanized antibody sequence
cagtcggtggaggagtctgggggtcgcctggtcacgcctgggacacccctgacactcacctgcacagcctctggattctccctcagtagatatgcaatgggctgggtccgccaggctccagggaaggggctggaatggatcggagacattagtacttatggtaccacagactacgcgagctgggtgaatggccgattcaccatctccagaacctcgaccacggtgactctgaaaatgaccagtctgacaaccgaggacacggccacctatttctgtgccagagactattggttgagcttgtggggccaaggcaccctcgtcaccgtctcgagc

SEQ ID NO: 573 - DNA, 87 bp, Oryctolagus cuniculus
cagtcggtggaggagtctgggggtcgcctggtcacgcctgggacacccctgacactcacctgcacagcctctggattctccctcagt

SEQ ID NO: 574 - DNA, 15 bp, Oryctolagus cuniculus
agatatgcaatgggc

SEQ ID NO: 575 - DNA, 42 bp, Oryctolagus cuniculus; identical to SEQ ID NO: 15

SEQ ID NO: 576 - DNA, 48 bp, Oryctolagus cuniculus
gacattagtacttatggtaccacagactacgcgagctgggtgaatggc

SEQ ID NO: 577 - DNA, 90 bp, Oryctolagus cuniculus; identical to SEQ ID NO: 537

SEQ ID NO: 578 - DNA, 18 bp, Oryctolagus cuniculus
gactattggttgagcttg

SEQ ID NO: 579 - DNA, 33 bp, Artificial
  Humanized antibody sequence
tggggccaaggcaccctcgtcaccgtctcgagc

SEQ ID NO: 580 - DNA, 990 bp, Artificial; identical to SEQ ID NO: 20
  Humanized antibody sequence

SEQ ID NO: 581 - protein, 218 aa, Artificial
  Humanized antibody sequence
AAVLTQTPSPVSAAVGGTVTIKCQSSQSVYDNNALAWYQQKPGQPPKLLIYAASNLASGVPDRFSGSGSGTQFTLTISGVQCDDAATYYCLGGYDDAADNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 582 - protein, 112 aa, Artificial
  Humanized antibody sequence
AAVLTQTPSPVSAAVGGTVTIKCQSSQSVYDNNALAWYQQKPGQPPKLLIYAASNLASGVPDRFSGSGSGTQFTLTISGVQCDDAATYYCLGGYDDAADNAFGGGTEVVVKR

SEQ ID NO: 583 - protein, 23 aa, Oryctolagus cuniculus
AAVLTQTPSPVSAAVGGTVTIKC

SEQ ID NO: 584 - protein, 13 aa, Oryctolagus cuniculus
QSSQSVYDNNALA

SEQ ID NO: 585 - protein, 15 aa, Oryctolagus cuniculus
WYQQKPGQPPKLLIY

SEQ ID NO: 586 - protein, 7 aa, Oryctolagus cuniculus
AASNLAS

SEQ ID NO: 587 - protein, 32 aa, Oryctolagus cuniculus
GVPDRFSGSGSGTQFTLTISGVQCDDAATYYC

SEQ ID NO: 588 - protein, 11 aa, Oryctolagus cuniculus
LGGYDDAADNA

SEQ ID NO: 589 - protein, 11 aa, Artificial
  Humanized antibody sequence
FGGGTEVVVKR

SEQ ID NO: 590 - protein, 106 aa, Artificial; identical to SEQ ID NO: 30
  Humanized antibody sequence

SEQ ID NO: 591 - DNA, 654 bp, Artificial
  Humanized antibody sequence
gcagccgtgctgacccagacaccatcgcccgtgtctgcagctgtgggaggcacagtcaccatcaagtgccagtccagtcagagtgtttatgataacaatgctttagcctggtatcagcagaaaccaggacagcctcccaagctcctgatctatgctgcatccaatctggcatctggggtcccagataggttcagcggcagtggatctgggacacagttcactctcaccatcagcggcgtgcagtgtgacgatgctgccacttactactgtctaggcggttatgatgatgctgctgataatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 592 - DNA, 336 bp, Artificial
  Humanized antibody sequence
gcagccgtgctgacccagacaccatcgcccgtgtctgcagctgtgggaggcacagtcaccatcaagtgccagtccagtcagagtgtttatgataacaatgctttagcctggtatcagcagaaaccaggacagcctcccaagctcctgatctatgctgcatccaatctggcatctggggtcccagataggttcagcggcagtggatctgggacacagttcactctcaccatcagcggcgtgcagtgtgacgatgctgccacttactactgtctaggcggttatgatgatgctgctgataatgctttcggcggagggaccgaggtggtggtcaaacgt

SEQ ID NO: 593 - DNA, 69 bp, Oryctolagus cuniculus; identical to SEQ ID NO: 553

SEQ ID NO: 594 - DNA, 39 bp, Oryctolagus cuniculus; identical to SEQ ID NO: 554

SEQ ID NO: 595 - DNA, 45 bp, Oryctolagus cuniculus
tggtatcagcagaaaccaggacagcctcccaagctcctgatctat

SEQ ID NO: 596 - DNA, 21 bp, Oryctolagus cuniculus
gctgcatccaatctggcatct

SEQ ID NO: 597 - DNA, 96 bp, Oryctolagus cuniculus
ggggtcccagataggttcagcggcagtggatctgggacacagttcactctcaccatcagcggcgtgcagtgtgacgatgctgccacttactactgt

SEQ ID NO: 598 - DNA, 33 bp, Oryctolagus cuniculus
ctaggcggttatgatgatgctgctgataatgct

SEQ ID NO: 599 - DNA, 33 bp, Artificial; identical to SEQ ID NO: 39
  Humanized antibody sequence

SEQ ID NO: 600 - DNA, 318 bp, Artificial; identical to SEQ ID NO: 40
  Humanized antibody sequence

SEQ ID NO: 601 - protein, 441 aa, Artificial
  Humanized antibody sequence
QSVEESGGRLVTPGTPLTLTCTASGFSLSSYAMGWVRQAPGKGLEWIGDISTYGTTDYASWVYGRFTISRTSTTVTLKMTSLTTEDTATYFCARDYWLSLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 602 - protein, 111 aa, Artificial
  Humanized antibody sequence
QSVEESGGRLVTPGTPLTLTCTASGFSLSSYAMGWVRQAPGKGLEWIGDISTYGTTDYASWVYGRFTISRTSTTVTLKMTSLTTEDTATYFCARDYWLSLWGQGTLVTVSS

SEQ ID NO: 603 - protein, 29 aa, Oryctolagus cuniculus
QSVEESGGRLVTPGTPLTLTCTASGFSLS

SEQ ID NO: 604 - protein, 5 aa, Oryctolagus cuniculus
SYAMG

SEQ ID NO: 605 - protein, 14 aa, Oryctolagus cuniculus
WVRQAPGKGLEWIG

SEQ ID NO: 606 - protein, 16 aa, Oryctolagus cuniculus
DISTYGTTDYASWVYG

SEQ ID NO: 607 - protein, 30 aa, Oryctolagus cuniculus; identical to SEQ ID NO: 527

SEQ ID NO: 608 - protein, 6 aa, Oryctolagus cuniculus
DYWLSL

SEQ ID NO: 609 - protein, 11 aa, Artificial
  Humanized antibody sequence
WGQGTLVTVSS

SEQ ID NO: 610 - protein, 330 aa, Artificial; identical to SEQ ID NO: 10
  Humanized antibody sequence

SEQ ID NO: 611 - DNA, 1323 bp, Artificial
  Humanized antibody sequence
cagtcggtggaggagtccgggggtcgcctggtcacgcctgggacacccctgacactcacctgcacagcctctggattctccctcagtagctatgcaatgggctgggtccgccaggctccagggaaggggctggaatggatcggagacattagtacttatggtaccacagactacgcgagctgggtgtatggccgattcaccatctccagaacctcgaccacggtgactctgaaaatgaccagtctgacaaccgaggacacggccacctatttctgtgccagagactattggttgagcttgtggggccaaggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 612 - DNA, 333 bp, Artificial
  Humanized antibody sequence
cagtcggtggaggagtccgggggtcgcctggtcacgcctgggacacccctgacactcacctgcacagcctctggattctccctcagtagctatgcaatgggctgggtccgccaggctccagggaaggggctggaatggatcggagacattagtacttatggtaccacagactacgcgagctgggtgtatggccgattcaccatctccagaacctcgaccacggtgactctgaaaatgaccagtctgacaaccgaggacacggccacctatttctgtgccagagactattggttgagcttgtggggccaaggcaccctggtcaccgtctcgagc

SEQ ID NO: 613 - DNA, 87 bp, Oryctolagus cuniculus
cagtcggtggaggagtccgggggtcgcctggtcacgcctgggacacccctgacactcacctgcacagcctctggattctccctcagt

SEQ ID NO: 614 - DNA, 15 bp, Oryctolagus cuniculus
agctatgcaatgggc

SEQ ID NO: 615 - DNA, 42 bp, Oryctolagus cuniculus; identical to SEQ ID NO: 15

SEQ ID NO: 616 - DNA, 48 bp, Oryctolagus cuniculus
gacattagtacttatggtaccacagactacgcgagctgggtgtatggc

SEQ ID NO: 617 - DNA, 90 bp, Oryctolagus cuniculus; identical to SEQ ID NO: 537

SEQ ID NO: 618 - DNA, 18 bp, Oryctolagus cuniculus
gactattggttgagcttg

SEQ ID NO: 619 - DNA, 33 bp, Artificial; identical to SEQ ID NO: 179
  Humanized antibody sequence

SEQ ID NO: 620 - DNA, 990 bp, Artificial; identical to SEQ ID NO: 20
  Humanized antibody sequence

SEQ ID NO: 621 - protein, 218 aa, Artificial
  Humanized antibody sequence
AAVLTQTPSPVSAAVGGTVTIKCQSSQSVYDNNALAWYQQKPGQPPKLLIYAASTLASGVPSRFSGSGSGTEFTLTISGVQCDDAATYYCLGGYYDPADNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 622 - protein, 112 aa, Artificial
  Humanized antibody sequence
AAVLTQTPSPVSAAVGGTVTIKCQSSQSVYDNNALAWYQQKPGQPPKLLIYAASTLASGVPSRFSGSGSGTEFTLTISGVQCDDAATYYCLGGYYDPADNAFGGGTEVVVKR

SEQ ID NO: 623 - protein, 23 aa, Oryctolagus cuniculus
AAVLTQTPSPVSAAVGGTVTIKC

SEQ ID NO: 624 - protein, 13 aa, Oryctolagus cuniculus
QSSQSVYDNNALA

SEQ ID NO: 625 - protein, 15 aa, Oryctolagus cuniculus
WYQQKPGQPPKLLIY

SEQ ID NO: 626 - protein, 7 aa, Oryctolagus cuniculus
AASTLAS

SEQ ID NO: 627 - protein, 32 aa, Oryctolagus cuniculus
GVPSRFSGSGSGTEFTLTISGVQCDDAATYYC

SEQ ID NO: 628 - protein, 11 aa, Oryctolagus cuniculus
LGGYYDPADNA

SEQ ID NO: 629 - protein, 11 aa, Artificial
  Humanized antibody sequence
FGGGTEVVVKR

SEQ ID NO: 630 - protein, 106 aa, Artificial; identical to SEQ ID NO: 30
  Humanized antibody sequence

SEQ ID NO: 631 - DNA, 654 bp, Artificial
  Humanized antibody sequence
gcagccgtgctgacccagacaccatcgcccgtgtctgcagctgtgggaggcacagtcaccatcaagtgccagtccagtcagagtgtttatgataacaatgctttagcctggtatcagcagaaaccagggcagcctcccaagctcctgatctatgctgcatccactctggcatctggggtcccatcgcggttcagtggcagtggatctgggacagagttcactctcaccatcagcggcgtgcagtgtgacgatgctgccacttactactgtctaggcggttattatgatcctgctgataatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 632 - DNA, 336 bp, Artificial
  Humanized antibody sequence
gcagccgtgctgacccagacaccatcgcccgtgtctgcagctgtgggaggcacagtcaccatcaagtgccagtccagtcagagtgtttatgataacaatgctttagcctggtatcagcagaaaccagggcagcctcccaagctcctgatctatgctgcatccactctggcatctggggtcccatcgcggttcagtggcagtggatctgggacagagttcactctcaccatcagcggcgtgcagtgtgacgatgctgccacttactactgtctaggcggttattatgatcctgctgataatgctttcggcggagggaccgaggtggtggtcaaacgt

SEQ ID NO: 633 - DNA, 69 bp, Oryctolagus cuniculus; identical to SEQ ID NO: 553

SEQ ID NO: 634 - DNA, 39 bp, Oryctolagus cuniculus; identical to SEQ ID NO: 554

SEQ ID NO: 635 - DNA, 45 bp, Oryctolagus cuniculus; identical to SEQ ID NO: 515

SEQ ID NO: 636 - DNA, 21 bp, Oryctolagus cuniculus
gctgcatccactctggcatct

SEQ ID NO: 637 - DNA, 96 bp, Oryctolagus cuniculus
ggggtcccatcgcggttcagtggcagtggatctgggacagagttcactctcaccatcagcggcgtgcagtgtgacgatgctgccacttactactgt

SEQ ID NO: 638 - DNA, 33 bp, Oryctolagus cuniculus
ctaggcggttattatgatcctgctgataatgct

SEQ ID NO: 639 - DNA, 33 bp, Artificial; identical to SEQ ID NO: 39
  Humanized antibody sequence

SEQ ID NO: 640 - DNA, 318 bp, Artificial; identical to SEQ ID NO: 40
  Humanized antibody sequence

SEQ ID NO: 641 - protein, 451 aa, Artificial
  Humanized antibody sequence
QSVEESGGRLVTPGTPLTLTCTVSGFSLSSYDMSWVRQAPGKGLEYIGIINTNDDTWYASWVKGRFTISKTSSTTVDLKMTSLTTEDTATYFCARISDAYVFDYAYYFTLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 642 - protein, 121 aa, Artificial
  Humanized antibody sequence
QSVEESGGRLVTPGTPLTLTCTVSGFSLSSYDMSWVRQAPGKGLEYIGIINTNDDTWYASWVKGRFTISKTSSTTVDLKMTSLTTEDTATYFCARISDAYVFDYAYYFTLWGQGTLVTVSS

SEQ ID NO: 643 - protein, 29 aa, Oryctolagus cuniculus
QSVEESGGRLVTPGTPLTLTCTVSGFSLS

SEQ ID NO: 644 - protein, 5 aa, Oryctolagus cuniculus
SYDMS

SEQ ID NO: 645 - protein, 14 aa, Oryctolagus cuniculus
WVRQAPGKGLEYIG

SEQ ID NO: 646 - protein, 16 aa, Oryctolagus cuniculus
IINTNDDTWYASWVKG

SEQ ID NO: 647 - protein, 31 aa, Oryctolagus cuniculus
RFTISKTSSTTVDLKMTSLTTEDTATYFCAR

SEQ ID NO: 648 - protein, 15 aa, Oryctolagus cuniculus
ISDAYVFDYAYYFTL

SEQ ID NO: 649 - protein, 11 aa, Artificial
  Humanized antibody sequence
WGQGTLVTVSS

SEQ ID NO: 650 - protein, 330 aa, Artificial; identical to SEQ ID NO: 10
  Humanized antibody sequence

SEQ ID NO: 651 - DNA, 1353 bp, Artificial
  Humanized antibody sequence
cagtcggtggaggagtccgggggtcgcctggtcacgcctgggacacccctgacactcacctgcaccgtctctggattctccctcagcagctacgacatgagctgggtccgccaggctccaggaaaggggctggaatacatcggcatcattaatactaatgatgacacatggtacgcgagctgggtgaaaggccgattcaccatctccaaaacctcgtcgaccacggtggatctgaaaatgaccagtctgacaaccgaggacacggccacctatttctgtgccagaatatccgatgcttatgtttttgattatgcgtattactttactttgtggggccaggggaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 652 - DNA, 363 bp, Artificial
  Humanized antibody sequence
cagtcggtggaggagtccgggggtcgcctggtcacgcctgggacacccctgacactcacctgcaccgtctctggattctccctcagcagctacgacatgagctgggtccgccaggctccaggaaaggggctggaatacatcggcatcattaatactaatgatgacacatggtacgcgagctgggtgaaaggccgattcaccatctccaaaacctcgtcgaccacggtggatctgaaaatgaccagtctgacaaccgaggacacggccacctatttctgtgccagaatatccgatgcttatgtttttgattatgcgtattactttactttgtggggccaggggaccctggtcaccgtctcgagc

SEQ ID NO: 653 - DNA, 87 bp, Oryctolagus cuniculus
cagtcggtggaggagtccgggggtcgcctggtcacgcctgggacacccctgacactcacctgcaccgtctctggattctccctcagc

SEQ ID NO: 654 - DNA, 15 bp, Oryctolagus cuniculus
agctacgacatgagc

SEQ ID NO: 655 - DNA, 42 bp, Oryctolagus cuniculus
tgggtccgccaggctccaggaaaggggctggaatacatcggc

SEQ ID NO: 656 - DNA, 48 bp, Oryctolagus cuniculus
atcattaatactaatgatgacacatggtacgcgagctgggtgaaaggc

SEQ ID NO: 657 - DNA, 93 bp, Oryctolagus cuniculus
cgattcaccatctccaaaacctcgtcgaccacggtggatctgaaaatgaccagtctgacaaccgaggacacggccacctatttctgtgccaga

SEQ ID NO: 658 - DNA, 45 bp, Oryctolagus cuniculus
atatccgatgcttatgtttttgattatgcgtattactttactttg

SEQ ID NO: 659 - DNA, 33 bp, Artificial
  Humanized antibody sequence
tggggccaggggaccctggtcaccgtctcgagc

SEQ ID NO: 660 - DNA, 990 bp, Artificial; identical to SEQ ID NO: 20
  Humanized antibody sequence

SEQ ID NO: 661 - protein, 217 aa, Artificial
  Humanized antibody sequence
ALVMTQTPSSVSAAVGGTVTINCLASQNIYNSLAWYQQKPGQPPKLLIYRASTLASGVSSRFKGSGSGTQFTLTISGVECADAATYYCQQGAGADNIGNPFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 662 - protein, 111 aa, Artificial
  Humanized antibody sequence
ALVMTQTPSSVSAAVGGTVTINCLASQNIYNSLAWYQQKPGQPPKLLIYRASTLASGVSSRFKGSGSGTQFTLTISGVECADAATYYCQQGAGADNIGNPFGGGTEVVVKR

SEQ ID NO: 663 - protein, 23 aa, Oryctolagus cuniculus
ALVMTQTPSSVSAAVGGTVTINC

SEQ ID NO: 664 - protein, 11 aa, Oryctolagus cuniculus
LASQNIYNSLA

SEQ ID NO: 665 - protein, 15 aa, Oryctolagus cuniculus
WYQQKPGQPPKLLIY

SEQ ID NO: 666 - protein, 7 aa, Oryctolagus cuniculus
RASTLAS

SEQ ID NO: 667 - protein, 32 aa, Oryctolagus cuniculus
GVSSRFKGSGSGTQFTLTISGVECADAATYYC

SEQ ID NO: 668 - protein, 12 aa, Oryctolagus cuniculus
QQGAGADNIGNP

SEQ ID NO: 669 - protein, 11 aa, Artificial
  Humanized antibody sequence
FGGGTEVVVKR

SEQ ID NO: 670 - protein, 106 aa, Artificial; identical to SEQ ID NO: 30
  Humanized antibody sequence

SEQ ID NO: 671 - DNA, 651 bp, Artificial
  Humanized antibody sequence
gcccttgtgatgacccagactccatcctccgtgtctgcagctgtgggaggcacagtcaccatcaattgcctggccagtcagaacatttacaattctttagcctggtatcagcagaaaccagggcagcctcccaagctcctgatctacagggcatccactctggcatctggggtctcatcgcggttcaaaggcagtggatctgggacacagttcactctcaccatcagcggcgtggagtgtgccgatgctgccacttactactgtcaacagggtgctggtgctgataatattggtaatcctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 672 - DNA, 333 bp, Artificial
  Humanized antibody sequence
gcccttgtgatgacccagactccatcctccgtgtctgcagctgtgggaggcacagtcaccatcaattgcctggccagtcagaacatttacaattctttagcctggtatcagcagaaaccagggcagcctcccaagctcctgatctacagggcatccactctggcatctggggtctcatcgcggttcaaaggcagtggatctgggacacagttcactctcaccatcagcggcgtggagtgtgccgatgctgccacttactactgtcaacagggtgctggtgctgataatattggtaatcctttcggcggagggaccgaggtggtggtcaaacgt

SEQ ID NO: 673 - DNA, 69 bp, Oryctolagus cuniculus
gcccttgtgatgacccagactccatcctccgtgtctgcagctgtgggaggcacagtcaccatcaattgc

SEQ ID NO: 674 - DNA, 33 bp, Oryctolagus cuniculus
ctggccagtcagaacatttacaattctttagcc

SEQ ID NO: 675 - DNA, 45 bp, Oryctolagus cuniculus; identical to SEQ ID NO: 395

SEQ ID NO: 676 - DNA, 21 bp, Oryctolagus cuniculus
agggcatccactctggcatct

SEQ ID NO: 677 - DNA, 96 bp, Oryctolagus cuniculus
ggggtctcatcgcggttcaaaggcagtggatctgggacacagttcactctcaccatcagcggcgtggagtgtgccgatgctgccacttactactgt

SEQ ID NO: 678 - DNA, 36 bp, Oryctolagus cuniculus
caacagggtgctggtgctgataatattggtaatcct

SEQ ID NO: 679 - DNA, 33 bp, Artificial; identical to SEQ ID NO: 39
  Humanized antibody sequence

SEQ ID NO: 680 - DNA, 318 bp, Artificial; identical to SEQ ID NO: 40
  Humanized antibody sequence

SEQ ID NO: 681 - protein, 452 aa, Artificial
  Humanized antibody sequence
QEQLVESGGGLVQPEGSLTLTCTASGFSFSSSDYMCWVRQAPGKGLEWIGCIDAGSSGDTYFASWAKGRFTISKTSSTTVTLQMTSLTAADTATYFCARHLYGSITFAFGLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 682 - protein, 122 aa, Artificial
  Humanized antibody sequence
QEQLVESGGGLVQPEGSLTLTCTASGFSFSSSDYMCWVRQAPGKGLEWIGCIDAGSSGDTYFASWAKGRFTISKTSSTTVTLQMTSLTAADTATYFCARHLYGSITFAFGLWGQGTLVTVSS

SEQ ID NO: 683 - protein, 30 aa, Oryctolagus cuniculus
QEQLVESGGGLVQPEGSLTLTCTASGFSFS

SEQ ID NO: 684 - protein, 6 aa, Oryctolagus cuniculus
SSDYMC

SEQ ID NO: 685 - protein, 14 aa, Oryctolagus cuniculus
WVRQAPGKGLEWIG

SEQ ID NO: 686 - protein, 18 aa, Oryctolagus cuniculus
CIDAGSSGDTYFASWAKG

SEQ ID NO: 687 - protein, 31 aa, Oryctolagus cuniculus
RFTISKTSSTTVTLQMTSLTAADTATYFCAR

SEQ ID NO: 688 - protein, 12 aa, Oryctolagus cuniculus
HLYGSITFAFGL

SEQ ID NO: 689 - protein, 11 aa, Artificial
  Humanized antibody sequence
WGQGTLVTVSS

SEQ ID NO: 690 - protein, 330 aa, Artificial; identical to SEQ ID NO: 10
  Humanized antibody sequence

SEQ ID NO: 691 - DNA, 1356 bp, Artificial
  Humanized antibody sequence
caggagcagctggtggagtccgggggaggcctggtccagcctgagggatccctgacactcacctgcacagcctctggattctccttcagtagcagcgactacatgtgctgggtccgccaggctccagggaaggggctggagtggatcggatgcattgatgctggtagtagtggtgacacttacttcgcgagctgggcgaaaggccgattcaccatctccaaaacctcgtcgaccacggtgactctgcaaatgaccagtctgacagccgcggacacggccacctatttctgtgcgagacatctttatggtagtattactttcgcctttggcttgtggggccagggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 692 - DNA, 366 bp, Artificial
  Humanized antibody sequence
caggagcagctggtggagtccgggggaggcctggtccagcctgagggatccctgacactcacctgcacagcctctggattctccttcagtagcagcgactacatgtgctgggtccgccaggctccagggaaggggctggagtggatcggatgcattgatgctggtagtagtggtgacacttacttcgcgagctgggcgaaaggccgattcaccatctccaaaacctcgtcgaccacggtgactctgcaaatgaccagtctgacagccgcggacacggccacctatttctgtgcgagacatctttatggtagtattactttcgcctttggcttgtggggccagggcaccctggtcaccgtctcgagc

SEQ ID NO: 693 - DNA, 90 bp, Oryctolagus cuniculus
caggagcagctggtggagtccgggggaggcctggtccagcctgagggatccctgacactcacctgcacagcctctggattctccttcagt

SEQ ID NO: 694 - DNA, 18 bp, Oryctolagus cuniculus
agcagcgactacatgtgc

SEQ ID NO: 695 - DNA, 42 bp, Oryctolagus cuniculus
tgggtccgccaggctccagggaaggggctggagtggatcgga

SEQ ID NO: 696 - DNA, 54 bp, Oryctolagus cuniculus
tgcattgatgctggtagtagtggtgacacttacttcgcgagctgggcgaaaggc

SEQ ID NO: 697 - DNA, 93 bp, Oryctolagus cuniculus
cgattcaccatctccaaaacctcgtcgaccacggtgactctgcaaatgaccagtctgacagccgcggacacggccacctatttctgtgcgaga

SEQ ID NO: 698 - DNA, 36 bp, Oryctolagus cuniculus
catctttatggtagtattactttcgcctttggcttg

SEQ ID NO: 699 - DNA, 33 bp, Artificial
  Humanized antibody sequence
tggggccagggcaccctggtcaccgtctcgagc

SEQ ID NO: 700 - DNA, 990 bp, Artificial; identical to SEQ ID NO: 20
  Humanized antibody sequence

SEQ ID NO: 701 - protein, 217 aa, Artificial
  Humanized antibody sequence
AAVLTQTPSPVSAAVGGTVTINCQASQSIGSDLAWYQQKPGQPPKLLIYDASTLASGVPSRFSGSGSGTQFTLTISGVQCDDAATYYCQGTYYSSGWYTAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 702 - protein, 111 aa, Artificial
  Humanized antibody sequence
AAVLTQTPSPVSAAVGGTVTINCQASQSIGSDLAWYQQKPGQPPKLLIYDASTLASGVPSRFSGSGSGTQFTLTISGVQCDDAATYYCQGTYYSSGWYTAFGGGTEVVVKR

SEQ ID NO: 703 - protein, 23 aa, Oryctolagus cuniculus
AAVLTQTPSPVSAAVGGTVTINC

SEQ ID NO: 704 - protein, 11 aa, Oryctolagus cuniculus
QASQSIGSDLA

SEQ ID NO: 705 - protein, 15 aa, Oryctolagus cuniculus
WYQQKPGQPPKLLIY

SEQ ID NO: 706 - protein, 7 aa, Oryctolagus cuniculus
DASTLAS

SEQ ID NO: 707 - protein, 32 aa, Oryctolagus cuniculus
GVPSRFSGSGSGTQFTLTISGVQCDDAATYYC

SEQ ID NO: 708 - protein, 12 aa, Oryctolagus cuniculus
QGTYYSSGWYTA

SEQ ID NO: 709 - protein, 11 aa, Artificial
  Humanized antibody sequence
FGGGTEVVVKR

SEQ ID NO: 710 - protein, 106 aa, Artificial; identical to SEQ ID NO: 30
  Humanized antibody sequence

SEQ ID NO: 711 - DNA, 651 bp, Artificial
  Humanized antibody sequence
gcagccgtgctgacccagacaccatcgcccgtgtctgcagctgtgggaggcacagtcaccatcaattgccaggccagtcagagcattggtagcgacttagcctggtatcagcagaaaccagggcagcctcccaagctcctgatctatgatgcatccactctggcatctggggtcccatcgcggttcagcggcagtggatctgggacacagttcactctcaccatcagcggcgtgcagtgtgacgatgctgccacttactactgtcaaggcacttattatagtagtggttggtacactgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 712 - DNA, 333 bp, Artificial
  Humanized antibody sequence
gcagccgtgctgacccagacaccatcgcccgtgtctgcagctgtgggaggcacagtcaccatcaattgccaggccagtcagagcattggtagcgacttagcctggtatcagcagaaaccagggcagcctcccaagctcctgatctatgatgcatccactctggcatctggggtcccatcgcggttcagcggcagtggatctgggacacagttcactctcaccatcagcggcgtgcagtgtgacgatgctgccacttactactgtcaaggcacttattatagtagtggttggtacactgctttcggcggagggaccgaggtggtggtcaaacgt

SEQ ID NO: 713 - DNA, 69 bp, Oryctolagus cuniculus
gcagccgtgctgacccagacaccatcgcccgtgtctgcagctgtgggaggcacagtcaccatcaattgc

SEQ ID NO: 714 - DNA, 33 bp, Oryctolagus cuniculus
caggccagtcagagcattggtagcgacttagcc

SEQ ID NO: 715 - DNA, 45 bp, Oryctolagus cuniculus; identical to SEQ ID NO: 515

SEQ ID NO: 716 - DNA, 21 bp, Oryctolagus cuniculus
gatgcatccactctggcatct

SEQ ID NO: 717 - DNA, 96 bp, Oryctolagus cuniculus
ggggtcccatcgcggttcagcggcagtggatctgggacacagttcactctcaccatcagcggcgtgcagtgtgacgatgctgccacttactactgt

SEQ ID NO: 718 - DNA, 36 bp, Oryctolagus cuniculus
caaggcacttattatagtagtggttggtacactgct

SEQ ID NO: 719 - DNA, 33 bp, Artificial; identical to SEQ ID NO: 39
  Humanized antibody sequence

SEQ ID NO: 720 - DNA, 318 bp, Artificial; identical to SEQ ID NO: 40
  Humanized antibody sequence

SEQ ID NO: 721 - protein, 447 aa, Artificial
  Humanized antibody sequence
QQLEQSGGGAEGGLVKPGGSLELCCKASGFSLSSTYWMCWVRQAPGKGLEWIGCIYTGSGSTDYASWVNGQFTLSRDIDQSTGCLQLNSLTVADTAMYYCTKNFDLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 722 - protein, 117 aa, Artificial
  Humanized antibody sequence
QQLEQSGGGAEGGLVKPGGSLELCCKASGFSLSSTYWMCWVRQAPGKGLEWIGCIYTGSGSTDYASWVNGQFTLSRDIDQSTGCLQLNSLTVADTAMYYCTKNFDLWGPGTLVTVSS

SEQ ID NO: 723 - protein, 33 aa, Oryctolagus cuniculus
QQLEQSGGGAEGGLVKPGGSLELCCKASGFSLS

SEQ ID NO: 724 - protein, 6 aa, Oryctolagus cuniculus
STYWMC

SEQ ID NO: 725 - protein, 14 aa, Oryctolagus cuniculus
WVRQAPGKGLEWIG

SEQ ID NO: 726 - protein, 17 aa, Oryctolagus cuniculus
CIYTGSGSTDYASWVNG

SEQ ID NO: 727 - protein, 32 aa, Oryctolagus cuniculus
QFTLSRDIDQSTGCLQLNSLTVADTAMYYCTK

SEQ ID NO: 728 - protein, 4 aa, Oryctolagus cuniculus
NFDL

SEQ ID NO: 729 - protein, 11 aa, Artificial
  Humanized antibody sequence
WGPGTLVTVSS

SEQ ID NO: 730 - protein, 330 aa, Artificial; identical to SEQ ID NO: 10
  Humanized antibody sequence

SEQ ID NO: 731 - DNA, 1341 bp, Artificial
  Humanized antibody sequence
cagcagctggagcagtccggaggaggagccgaaggaggcctggtcaagcctgggggatccctggaactctgctgcaaggcctctggattctccctcagtagcacctactggatgtgctgggtccgccaggctccagggaaggggctggagtggattggatgcatttatactggtagtggtagcacagactacgcgagctgggtgaatggccaattcactctctccagagacatcgaccagagcacaggttgcctacaactgaacagtctgacagtcgcggacacggccatgtattactgtacgaaaaattttgacttgtggggcccgggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 732 - DNA, 351 bp, Artificial
  Humanized antibody sequence
cagcagctggagcagtccggaggaggagccgaaggaggcctggtcaagcctgggggatccctggaactctgctgcaaggcctctggattctccctcagtagcacctactggatgtgctgggtccgccaggctccagggaaggggctggagtggattggatgcatttatactggtagtggtagcacagactacgcgagctgggtgaatggccaattcactctctccagagacatcgaccagagcacaggttgcctacaactgaacagtctgacagtcgcggacacggccatgtattactgtacgaaaaattttgacttgtggggcccgggcaccctggtcaccgtctcgagc

SEQ ID NO: 733 - DNA, 99 bp, Oryctolagus cuniculus
cagcagctggagcagtccggaggaggagccgaaggaggcctggtcaagcctgggggatccctggaactctgctgcaaggcctctggattctccctcagt

SEQ ID NO: 734 - DNA, 18 bp, Oryctolagus cuniculus
agcacctactggatgtgc

SEQ ID NO: 735 - DNA, 42 bp, Oryctolagus cuniculus
tgggtccgccaggctccagggaaggggctggagtggattgga

SEQ ID NO: 736 - DNA, 51 bp, Oryctolagus cuniculus
tgcatttatactggtagtggtagcacagactacgcgagctgggtgaatggc

SEQ ID NO: 737 - DNA, 96 bp, Oryctolagus cuniculus
caattcactctctccagagacatcgaccagagcacaggttgcctacaactgaacagtctgacagtcgcggacacggccatgtattactgtacgaaa

SEQ ID NO: 738 - DNA, 12 bp, Oryctolagus cuniculus
aattttgacttg

SEQ ID NO: 739 - DNA, 33 bp, Artificial; identical to SEQ ID NO: 379
  Humanized antibody sequence

SEQ ID NO: 740 - DNA, 990 bp, Artificial; identical to SEQ ID NO: 20
  Humanized antibody sequence

SEQ ID NO: 741 - protein, 220 aa, Artificial
  Humanized antibody sequence
AQVLTQTPSSVSAAVGGTVTINCQSSPSVYSNNYLSWFQQKPGQPPKGLIADASTLASGVPSRFKGSGSGTQFTLTISGVQCDDAAAYYCLGYYDCGSTDCHAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 742 - protein, 114 aa, Artificial
  Humanized antibody sequence
AQVLTQTPSSVSAAVGGTVTINCQSSPSVYSNNYLSWFQQKPGQPPKGLIADASTLASGVPSRFKGSGSGTQFTLTISGVQCDDAAAYYCLGYYDCGSTDCHAFGGGTEVVVKR

SEQ ID NO: 743 - protein, 23 aa, Oryctolagus cuniculus
AQVLTQTPSSVSAAVGGTVTINC

SEQ ID NO: 744 - protein, 13 aa, Oryctolagus cuniculus
QSSPSVYSNNYLS

SEQ ID NO: 745 - protein, 15 aa, Oryctolagus cuniculus
WFQQKPGQPPKGLIA

SEQ ID NO: 746 - protein, 7 aa, Oryctolagus cuniculus
DASTLAS

SEQ ID NO: 747 - protein, 32 aa, Oryctolagus cuniculus
GVPSRFKGSGSGTQFTLTISGVQCDDAAAYYC

SEQ ID NO: 748 - protein, 13 aa, Oryctolagus cuniculus
LGYYDCGSTDCHA

SEQ ID NO: 749 - protein, 11 aa, Artificial
  Humanized antibody sequence
FGGGTEVVVKR

SEQ ID NO: 750 - protein, 106 aa, Artificial; identical to SEQ ID NO: 30
  Humanized antibody sequence

SEQ ID NO: 751 - DNA, 660 bp, Artificial
  Humanized antibody sequence
gcccaagtgctgacccagactccatcctccgtgtctgcagctgtgggaggcacagtcaccatcaattgccagtccagtccgagtgtttatagtaacaactacttatcctggtttcagcagaaaccagggcagcctcccaaaggcctgatcgctgatgcatccactctggcatctggggtcccatcgcggttcaaaggcagtggatctgggacacagttcactctcaccatcagcggcgtgcagtgtgacgatgctgccgcttactactgtctaggctattatgattgtggtagtactgattgtcatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 752 - DNA, 342 bp, Artificial
  Humanized antibody sequence
gcccaagtgctgacccagactccatcctccgtgtctgcagctgtgggaggcacagtcaccatcaattgccagtccagtccgagtgtttatagtaacaactacttatcctggtttcagcagaaaccagggcagcctcccaaaggcctgatcgctgatgcatccactctggcatctggggtcccatcgcggttcaaaggcagtggatctgggacacagttcactctcaccatcagcggcgtgcagtgtgacgatgctgccgcttactactgtctaggctattatgattgtggtagtactgattgtcatgctttcggcggagggaccgaggtggtggtcaaacgt

SEQ ID NO: 753 - DNA, 69 bp, Oryctolagus cuniculus
gcccaagtgctgacccagactccatcctccgtgtctgcagctgtgggaggcacagtcaccatcaattgc

SEQ ID NO: 754 - DNA, 39 bp, Oryctolagus cuniculus
cagtccagtccgagtgtttatagtaacaactacttatcc

SEQ ID NO: 755 - DNA, 45 bp, Oryctolagus cuniculus
tggtttcagcagaaaccagggcagcctcccaaaggcctgatcgct

SEQ ID NO: 756 - DNA, 21 bp, Oryctolagus cuniculus
gatgcatccactctggcatct

SEQ ID NO: 757 - DNA, 96 bp, Oryctolagus cuniculus
ggggtcccatcgcggttcaaaggcagtggatctgggacacagttcactctcaccatcagcggcgtgcagtgtgacgatgctgccgcttactactgt

SEQ ID NO: 758 - DNA, 39 bp, Oryctolagus cuniculus
ctaggctattatgattgtggtagtactgattgtcatgct

SEQ ID NO: 759 - DNA, 33 bp, Artificial; identical to SEQ ID NO: 39
  Humanized antibody sequence

SEQ ID NO: 760 - DNA, 318 bp, Artificial; identical to SEQ ID NO: 40
  Humanized antibody sequence

SEQ ID NO: 761 - protein, 447 aa, Artificial
  Humanized antibody sequence
QQLEQSGGGAEGGLVKPGGSLELCCKASGFSLTTSHWMCWVRQAPGKGLNWIGCISAGSGDADYATWVDAQFTLSRDIDQNTGCLQLNSLTPADTAMYYCTINFELWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 762 - protein, 117 aa, Artificial
  Humanized antibody sequence
QQLEQSGGGAEGGLVKPGGSLELCCKASGFSLTTSHWMCWVRQAPGKGLNWIGCISAGSGDADYATWVDAQFTLSRDIDQNTGCLQLNSLTPADTAMYYCTINFELWGQGTLVTVSS

SEQ ID NO: 763 - protein, 33 aa, Oryctolagus cuniculus
QQLEQSGGGAEGGLVKPGGSLELCCKASGFSLT

SEQ ID NO: 764 - protein, 6 aa, Oryctolagus cuniculus
TSHWMC

SEQ ID NO: 765 - protein, 14 aa, Oryctolagus cuniculus
WVRQAPGKGLNWIG

SEQ ID NO: 766 - protein, 17 aa, Oryctolagus cuniculus
CISAGSGDADYATWVDA

SEQ ID NO: 767 - protein, 32 aa, Oryctolagus cuniculus
QFTLSRDIDQNTGCLQLNSLTPADTAMYYCTI

SEQ ID NO: 768 - protein, 4 aa, Oryctolagus cuniculus
NFEL

SEQ ID NO: 769 - protein, 11 aa, Artificial
  Humanized antibody sequence
WGQGTLVTVSS

SEQ ID NO: 770 - protein, 330 aa, Artificial; identical to SEQ ID NO: 10
  Humanized antibody sequence

SEQ ID NO: 771 - DNA, 1341 bp, Artificial
  Humanized antibody sequence
cagcagctggagcagtccggaggaggagccgaaggaggcctggtcaagcctgggggatccctggaactctgctgcaaagcctctggattctccctcactacgagccactggatgtgttgggtccgccaggctccagggaaggggctgaattggattggatgcattagtgccggtagtggtgacgcagactacgcgacctgggtggatgcccaattcactctctccagagacatcgaccagaacacaggttgcctacaattgaacagtctgacacccgcggacacggccatgtattactgtacgataaattttgagttgtggggccaaggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 772 - DNA, 351 bp, Artificial
  Humanized antibody sequence
cagcagctggagcagtccggaggaggagccgaaggaggcctggtcaagcctgggggatccctggaactctgctgcaaagcctctggattctccctcactacgagccactggatgtgttgggtccgccaggctccagggaaggggctgaattggattggatgcattagtgccggtagtggtgacgcagactacgcgacctgggtggatgcccaattcactctctccagagacatcgaccagaacacaggttgcctacaattgaacagtctgacacccgcggacacggccatgtattactgtacgataaattttgagttgtggggccaaggcaccctggtcaccgtctcgagc

SEQ ID NO: 773 - DNA, 99 bp, Oryctolagus cuniculus
cagcagctggagcagtccggaggaggagccgaaggaggcctggtcaagcctgggggatccctggaactctgctgcaaagcctctggattctccctcact

SEQ ID NO: 774 - DNA, 18 bp, Oryctolagus cuniculus
acgagccactggatgtgt

SEQ ID NO: 775 - DNA, 42 bp, Oryctolagus cuniculus
tgggtccgccaggctccagggaaggggctgaattggattgga

SEQ ID NO: 776 - DNA, 51 bp, Oryctolagus cuniculus
tgcattagtgccggtagtggtgacgcagactacgcgacctgggtggatgcc

SEQ ID NO: 777 - DNA, 96 bp, Oryctolagus cuniculus
caattcactctctccagagacatcgaccagaacacaggttgcctacaattgaacagtctgacacccgcggacacggccatgtattactgtacgata

SEQ ID NO: 778 - DNA, 12 bp, Oryctolagus cuniculus
aattttgagttg

SEQ ID NO: 779 - DNA, 33 bp, Artificial; identical to SEQ ID NO: 179
  Humanized antibody sequence

SEQ ID NO: 780 - DNA, 990 bp, Artificial; identical to SEQ ID NO: 20
  Humanized antibody sequence

SEQ ID NO: 781 - protein, 219 aa, Artificial
  Humanized antibody sequence
AQVLTQTPSSVSAAVGGTVTINCQSSPSVYSSYLSWFQQKPGQPPKFLIYEASKLASGVPSRFSGSGSGTQFTLTISGVQCSDAATYYCLGAYDCGRTDCHAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 782 - protein, 113 aa, Artificial
  Humanized antibody sequence
AQVLTQTPSSVSAAVGGTVTINCQSSPSVYSSYLSWFQQKPGQPPKFLIYEASKLASGVPSRFSGSGSGTQFTLTISGVQCSDAATYYCLGAYDCGRTDCHAFGGGTEVVVKR

SEQ ID NO: 783 - protein, 23 aa, Oryctolagus cuniculus
AQVLTQTPSSVSAAVGGTVTINC

SEQ ID NO: 784 - protein, 12 aa, Oryctolagus cuniculus
QSSPSVYSSYLS

SEQ ID NO: 785 - protein, 15 aa, Oryctolagus cuniculus
WFQQKPGQPPKFLIY

SEQ ID NO: 786 - protein, 7 aa, Oryctolagus cuniculus
EASKLAS

SEQ ID NO: 787 - protein, 32 aa, Oryctolagus cuniculus
GVPSRFSGSGSGTQFTLTISGVQCSDAATYYC

SEQ ID NO: 788 - protein, 13 aa, Oryctolagus cuniculus
LGAYDCGRTDCHA

SEQ ID NO: 789 - protein, 11 aa, Artificial
  Humanized antibody sequence
FGGGTEVVVKR

SEQ ID NO: 790 - protein, 106 aa, Artificial; identical to SEQ ID NO: 30
  Humanized antibody sequence

SEQ ID NO: 791 - DNA, 657 bp, Artificial
  Humanized antibody sequence
gcccaagtgctgacccagactccatcctccgtgtctgcagctgtgggaggcacagtcaccatcaattgccagtccagtccgagtgtttatagtagctacttatcctggtttcagcagaaaccagggcagcctcccaagttcctgatctacgaagcatccaaactggcatctggggtcccatcgcggttcagcggcagtggatctgggacacagttcactctcaccatcagcggcgtgcagtgtagcgatgctgccacttactactgtcttggcgcgtatgattgtggtcgtactgattgtcatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 792 - DNA, 339 bp, Artificial
  Humanized antibody sequence
gcccaagtgctgacccagactccatcctccgtgtctgcagctgtgggaggcacagtcaccatcaattgccagtccagtccgagtgtttatagtagctacttatcctggtttcagcagaaaccagggcagcctcccaagttcctgatctacgaagcatccaaactggcatctggggtcccatcgcggttcagcggcagtggatctgggacacagttcactctcaccatcagcggcgtgcagtgtagcgatgctgccacttactactgtcttggcgcgtatgattgtggtcgtactgattgtcatgctttcggcggagggaccgaggtggtggtcaaacgt

SEQ ID NO: 793 - DNA, 69 bp, Oryctolagus cuniculus; identical to SEQ ID NO: 753

SEQ ID NO: 794 - DNA, 36 bp, Oryctolagus cuniculus
cagtccagtccgagtgtttatagtagctacttatcc

SEQ ID NO: 795 - DNA, 45 bp, Oryctolagus cuniculus
tggtttcagcagaaaccagggcagcctcccaagttcctgatctac

SEQ ID NO: 796 - DNA, 21 bp, Oryctolagus cuniculus
gaagcatccaaactggcatct

SEQ ID NO: 797 - DNA, 96 bp, Oryctolagus cuniculus
ggggtcccatcgcggttcagcggcagtggatctgggacacagttcactctcaccatcagcggcgtgcagtgtagcgatgctgccacttactactgt

SEQ ID NO: 798 - DNA, 39 bp, Oryctolagus cuniculus
cttggcgcgtatgattgtggtcgtactgattgtcatgct

SEQ ID NO: 799 - DNA, 33 bp, Artificial; identical to SEQ ID NO: 39
  Humanized antibody sequence

SEQ ID NO: 800 - DNA, 318 bp, Artificial; identical to SEQ ID NO: 40
  Humanized antibody sequence

SEQ ID NO: 801 - protein, 447 aa, Artificial
  Humanized antibody sequence
QQLEQSGGGAEGGLVKPGGSLKLSCKASGFTISRDYWICWVRQAPGKGLEWIGCISAGGGSTDYANWVNGRFTLSRDIDQSTGCLQLNSLTDADTAMYYCAGNLEIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 802 - protein, 117 aa, Artificial
  Humanized antibody sequence
QQLEQSGGGAEGGLVKPGGSLKLSCKASGFTISRDYWICWVRQAPGKGLEWIGCISAGGGSTDYANWVNGRFTLSRDIDQSTGCLQLNSLTDADTAMYYCAGNLEIWGQGTLVTVSS

SEQ ID NO: 803 - protein, 33 aa, Oryctolagus cuniculus
QQLEQSGGGAEGGLVKPGGSLKLSCKASGFTIS

SEQ ID NO: 804 - protein, 6 aa, Oryctolagus cuniculus
RDYWIC

SEQ ID NO: 805 - protein, 14 aa, Oryctolagus cuniculus
WVRQAPGKGLEWIG

SEQ ID NO: 806 - protein, 17 aa, Oryctolagus cuniculus
CISAGGGSTDYANWVNG

SEQ ID NO: 807 - protein, 32 aa, Oryctolagus cuniculus
RFTLSRDIDQSTGCLQLNSLTDADTAMYYCAG

SEQ ID NO: 808 - protein, 4 aa, Oryctolagus cuniculus
NLEI

SEQ ID NO: 809 - protein, 11 aa, Artificial
  Humanized antibody sequence
WGQGTLVTVSS

SEQ ID NO: 810 - protein, 330 aa, Artificial; identical to SEQ ID NO: 10
  Humanized antibody sequence

SEQ ID NO: 811 - DNA, 1341 bp, Artificial
  Humanized antibody sequence
cagcagctggagcagtccggaggaggagccgaaggaggcctggtcaagcctgggggatccctgaaactctcctgcaaagcctctggattcaccatcagtagggactactggatatgttgggtccgccaggctccagggaaggggctggagtggattggatgcattagtgctggtggtggtagcacagactacgcgaactgggtgaatggccgattcactctctccagagacatcgaccagagcacaggttgccttcaactgaacagtctgacagacgcggacacggccatgtattactgtgcgggaaatctagagatctggggccaagggaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 812 - DNA, 351 bp, Artificial
  Humanized antibody sequence
cagcagctggagcagtccggaggaggagccgaaggaggcctggtcaagcctgggggatccctgaaactctcctgcaaagcctctggattcaccatcagtagggactactggatatgttgggtccgccaggctccagggaaggggctggagtggattggatgcattagtgctggtggtggtagcacagactacgcgaactgggtgaatggccgattcactctctccagagacatcgaccagagcacaggttgccttcaactgaacagtctgacagacgcggacacggccatgtattactgtgcgggaaatctagagatctggggccaagggaccctggtcaccgtctcgagc

SEQ ID NO: 813 - DNA, 99 bp, Oryctolagus cuniculus
cagcagctggagcagtccggaggaggagccgaaggaggcctggtcaagcctgggggatccctgaaactctcctgcaaagcctctggattcaccatcagt

SEQ ID NO: 814 - DNA, 18 bp, Oryctolagus cuniculus
agggactactggatatgt

SEQ ID NO: 815 - DNA, 42 bp, Oryctolagus cuniculus; identical to SEQ ID NO: 735

SEQ ID NO: 816 - DNA, 51 bp, Oryctolagus cuniculus
tgcattagtgctggtggtggtagcacagactacgcgaactgggtgaatggc

SEQ ID NO: 817 - DNA, 96 bp, Oryctolagus cuniculus
cgattcactctctccagagacatcgaccagagcacaggttgccttcaactgaacagtctgacagacgcggacacggccatgtattactgtgcggga

SEQ ID NO: 818 - DNA, 12 bp, Oryctolagus cuniculus
aatctagagatc

SEQ ID NO: 819 - DNA, 33 bp, Artificial; identical to SEQ ID NO: 99
  Humanized antibody sequence

SEQ ID NO: 820 - DNA, 990 bp, Artificial; identical to SEQ ID NO: 20
  Humanized antibody sequence

SEQ ID NO: 821 - protein, 220 aa, Artificial
  Humanized antibody sequence
AQVLTQTPSSVSAAVGGTVTINCQSSPSIYSGAFLSWFQQKPGQPPKFLIYEASKLASGVPSRFSGSGSGTQFTLTISDVQCDDAATYYCLGFYDCSSVDCHAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 822 - protein, 114 aa, Artificial
  Humanized antibody sequence
AQVLTQTPSSVSAAVGGTVTINCQSSPSIYSGAFLSWFQQKPGQPPKFLIYEASKLASGVPSRFSGSGSGTQFTLTISDVQCDDAATYYCLGFYDCSSVDCHAFGGGTEVVVKR

SEQ ID NO: 823 - protein, 23 aa, Oryctolagus cuniculus
AQVLTQTPSSVSAAVGGTVTINC

SEQ ID NO: 824 - protein, 13 aa, Oryctolagus cuniculus
QSSPSIYSGAFLS

SEQ ID NO: 825 - protein, 15 aa, Oryctolagus cuniculus
WFQQKPGQPPKFLIY

SEQ ID NO: 826 - protein, 7 aa, Oryctolagus cuniculus
EASKLAS

SEQ ID NO: 827 - protein, 32 aa, Oryctolagus cuniculus
GVPSRFSGSGSGTQFTLTISDVQCDDAATYYC

SEQ ID NO: 828 - protein, 13 aa, Oryctolagus cuniculus
LGFYDCSSVDCHA

SEQ ID NO: 829 - protein, 11 aa, Artificial
  Humanized antibody sequence
FGGGTEVVVKR

SEQ ID NO: 830 - protein, 106 aa, Artificial; identical to SEQ ID NO: 30
  Humanized antibody sequence

SEQ ID NO: 831 - DNA, 660 bp, Artificial
  Humanized antibody sequence
gcccaagtgctgacccagactccatcctccgtgtctgcagctgtgggaggcacagtcaccatcaattgccagtccagtccgagtatttatagtggcgcctttttatcctggtttcagcagaaaccagggcagcctcccaagttcctgatctacgaagcctccaaactggcatctggggtcccatcgcggttcagtggcagtggatctgggacacagttcactctcaccatcagcgacgtacagtgtgacgatgctgccacttactactgtctaggcttttatgattgtagcagtgttgattgccatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 832 - DNA, 342 bp, Artificial
  Humanized antibody sequence
gcccaagtgctgacccagactccatcctccgtgtctgcagctgtgggaggcacagtcaccatcaattgccagtccagtccgagtatttatagtggcgcctttttatcctggtttcagcagaaaccagggcagcctcccaagttcctgatctacgaagcctccaaactggcatctggggtcccatcgcggttcagtggcagtggatctgggacacagttcactctcaccatcagcgacgtacagtgtgacgatgctgccacttactactgtctaggcttttatgattgtagcagtgttgattgccatgctttcggcggagggaccgaggtggtggtcaaacgt

SEQ ID NO: 833 - DNA, 69 bp, Oryctolagus cuniculus; identical to SEQ ID NO: 753

SEQ ID NO: 834 - DNA, 39 bp, Oryctolagus cuniculus
cagtccagtccgagtatttatagtggcgcctttttatcc

SEQ ID NO: 835 - DNA, 45 bp, Oryctolagus cuniculus; identical to SEQ ID NO: 795

SEQ ID NO: 836 - DNA, 21 bp, Oryctolagus cuniculus
gaagcctccaaactggcatct

SEQ ID NO: 837 - DNA, 96 bp, Oryctolagus cuniculus
ggggtcccatcgcggttcagtggcagtggatctgggacacagttcactctcaccatcagcgacgtacagtgtgacgatgctgccacttactactgt

SEQ ID NO: 838 - DNA, 39 bp, Oryctolagus cuniculus
ctaggcttttatgattgtagcagtgttgattgccatgct

SEQ ID NO: 839 - DNA, 33 bp, Artificial; identical to SEQ ID NO: 39
  Humanized antibody sequence

SEQ ID NO: 840 - DNA, 318 bp, Artificial; identical to SEQ ID NO: 40
  Humanized antibody sequence

SEQ ID NO: 841-880 - skipped (40 entries)

SEQ ID NO: 881 - protein, 442 aa, Artificial
  Humanized antibody sequence
QEQLVESGGGLVQPEGSLTLTCTASGFDFSSNAMCWVRQAPGKGLEWIGSIYNADGKNYYAIWAKGRFTISRTSSTTVTLQMTSLTAADTATYFCARDFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 882 - protein, 112 aa, Artificial
  Humanized antibody sequence
QEQLVESGGGLVQPEGSLTLTCTASGFDFSSNAMCWVRQAPGKGLEWIGSIYNADGKNYYAIWAKGRFTISRTSSTTVTLQMTSLTAADTATYFCARDFDLWGQGTLVTVSS

SEQ ID NO: 883 - protein, 30 aa, Oryctolagus cuniculus
QEQLVESGGGLVQPEGSLTLTCTASGFDFS

SEQ ID NO: 884 - protein, 5 aa, Oryctolagus cuniculus
SNAMC

SEQ ID NO: 885 - protein, 14 aa, Oryctolagus cuniculus
WVRQAPGKGLEWIG

SEQ ID NO: 886 - protein, 17 aa, Oryctolagus cuniculus
SIYNADGKNYYAIWAKG

SEQ ID NO: 887 - protein, 31 aa, Oryctolagus cuniculus
RFTISRTSSTTVTLQMTSLTAADTATYFCAR

SEQ ID NO: 888 - protein, 4 aa, Oryctolagus cuniculus
DFDL

SEQ ID NO: 889 - protein, 11 aa, Artificial
  Humanized antibody sequence
WGQGTLVTVSS

SEQ ID NO: 890 - protein, 330 aa, Artificial; identical to SEQ ID NO: 10
  Humanized antibody sequence

SEQ ID NO: 891 - DNA, 1326 bp, Artificial
  Humanized antibody sequence
caggagcagctggtggagtccgggggaggcctggtccagcctgagggatccctgacactcacctgcacagcctctggattcgacttcagtagcaatgcaatgtgctgggtccgccaggctccagggaagggcctggagtggatcggatccatttataatgctgatggtaagaattattacgcgatttgggcgaaaggccgattcaccatctccagaacctcgtcgaccacggtgactctgcaaatgaccagtctgacagccgcggacacggccacctatttctgtgcgagagactttgacttgtggggccagggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 892 - DNA, 336 bp, Artificial
  Humanized antibody sequence
caggagcagctggtggagtccgggggaggcctggtccagcctgagggatccctgacactcacctgcacagcctctggattcgacttcagtagcaatgcaatgtgctgggtccgccaggctccagggaagggcctggagtggatcggatccatttataatgctgatggtaagaattattacgcgatttgggcgaaaggccgattcaccatctccagaacctcgtcgaccacggtgactctgcaaatgaccagtctgacagccgcggacacggccacctatttctgtgcgagagactttgacttgtggggccagggcaccctcgtcaccgtctcgagc

SEQ ID NO: 893 - DNA, 90 bp, Oryctolagus cuniculus
caggagcagctggtggagtccgggggaggcctggtccagcctgagggatccctgacactcacctgcacagcctctggattcgacttcagt

SEQ ID NO: 894 - DNA, 15 bp, Oryctolagus cuniculus
agcaatgcaatgtgc

SEQ ID NO: 895 - DNA, 42 bp, Oryctolagus cuniculus
tgggtccgccaggctccagggaagggcctggagtggatcgga

SEQ ID NO: 896 - DNA, 51 bp, Oryctolagus cuniculus
tccatttataatgctgatggtaagaattattacgcgatttgggcgaaaggc

SEQ ID NO: 897 - DNA, 93 bp, Oryctolagus cuniculus
cgattcaccatctccagaacctcgtcgaccacggtgactctgcaaatgaccagtctgacagccgcggacacggccacctatttctgtgcgaga

SEQ ID NO: 898 - DNA, 12 bp, Oryctolagus cuniculus
gactttgacttg

SEQ ID NO: 899 - DNA, 33 bp, Artificial; identical to SEQ ID NO: 219
  Humanized antibody sequence

SEQ ID NO: 900 - DNA, 990 bp, Artificial; identical to SEQ ID NO: 20
  Humanized antibody sequence

SEQ ID NO: 901 - protein, 219 aa, Artificial
  Humanized antibody sequence
AAVLTQTPSPVSAAVGGTVTINCQSSQSVYDNDWLAWFQQKPGQPPKLLIYLTSTLASGVPSRFSGSGSGTQFTLTISGVQCDDAATYYCLGGYDEDGDTHVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 902 - protein, 113 aa, Artificial
  Humanized antibody sequence
AAVLTQTPSPVSAAVGGTVTINCQSSQSVYDNDWLAWFQQKPGQPPKLLIYLTSTLASGVPSRFSGSGSGTQFTLTISGVQCDDAATYYCLGGYDEDGDTHVFGGGTEVVVKR

SEQ ID NO: 903 - protein, 23 aa, Oryctolagus cuniculus
AAVLTQTPSPVSAAVGGTVTINC

SEQ ID NO: 904 - protein, 13 aa, Oryctolagus cuniculus
QSSQSVYDNDWLA

SEQ ID NO: 905 - protein, 15 aa, Oryctolagus cuniculus
WFQQKPGQPPKLLIY

SEQ ID NO: 906 - protein, 7 aa, Oryctolagus cuniculus
LTSTLAS

SEQ ID NO: 907 - protein, 32 aa, Oryctolagus cuniculus; identical to SEQ ID NO: 707

SEQ ID NO: 908 - protein, 12 aa, Oryctolagus cuniculus
LGGYDEDGDTHV

SEQ ID NO: 909 - protein, 11 aa, Artificial
  Humanized antibody sequence
FGGGTEVVVKR

SEQ ID NO: 910 - protein, 106 aa, Artificial; identical to SEQ ID NO: 30
  Humanized antibody sequence

SEQ ID NO: 911 - DNA, 657 bp, Artificial
  Humanized antibody sequence
gcagccgtgctgacccagacaccatcgcccgtgtctgcagctgtgggaggcacagtcaccatcaattgccagtccagtcagagtgtttatgataacgactggttagcctggttccagcagaaaccagggcagcctcccaagctcctgatctatctgacatccactctggcatctggagtcccatcgcggttcagcggcagtggatctgggacacagttcactctcaccatcagtggtgtgcagtgtgacgatgctgccacttactactgtctaggcggctatgatgaagatggtgatacgcatgttttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 912 - DNA, 339 bp, Artificial
  Humanized antibody sequence
gcagccgtgctgacccagacaccatcgcccgtgtctgcagctgtgggaggcacagtcaccatcaattgccagtccagtcagagtgtttatgataacgactggttagcctggttccagcagaaaccagggcagcctcccaagctcctgatctatctgacatccactctggcatctggagtcccatcgcggttcagcggcagtggatctgggacacagttcactctcaccatcagtggtgtgcagtgtgacgatgctgccacttactactgtctaggcggctatgatgaagatggtgatacgcatgttttcggcggagggaccgaggtggtggtcaaacgt

SEQ ID NO: 913 - DNA, 69 bp, Oryctolagus cuniculus; identical to SEQ ID NO: 713

SEQ ID NO: 914 - DNA, 39 bp, Oryctolagus cuniculus
cagtccagtcagagtgtttatgataacgactggttagcc

SEQ ID NO: 915 - DNA, 45 bp, Oryctolagus cuniculus
tggttccagcagaaaccagggcagcctcccaagctcctgatctat

SEQ ID NO: 916 - DNA, 21 bp, Oryctolagus cuniculus
ctgacatccactctggcatct

SEQ ID NO: 917 - DNA, 96 bp, Oryctolagus cuniculus
ggagtcccatcgcggttcagcggcagtggatctgggacacagttcactctcaccatcagtggtgtgcagtgtgacgatgctgccacttactactgt

SEQ ID NO: 918 - DNA, 36 bp, Oryctolagus cuniculus
ctaggcggctatgatgaagatggtgatacgcatgtt

SEQ ID NO: 919 - DNA, 33 bp, Artificial; identical to SEQ ID NO: 39
  Humanized antibody sequence

SEQ ID NO: 920 - DNA, 318 bp, Artificial; identical to SEQ ID NO: 40
  Humanized antibody sequence

SEQ ID NO: 921 - protein, 447 aa, Artificial
  Humanized antibody sequence
QSVEESGGRLVTPGTPLTLTCTVSGFSLNNYAMSWVRQAPGKGLEWIGIMGVNDITYYASWAKGRFTISKTSTTVDLKMTSLTTEDTATYFCTREIRDDGDSSDKLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 922 - protein, 117 aa, Artificial
  Humanized antibody sequence
QSVEESGGRLVTPGTPLTLTCTVSGFSLNNYAMSWVRQAPGKGLEWIGIMGVNDITYYASWAKGRFTISKTSTTVDLKMTSLTTEDTATYFCTREIRDDGDSSDKLWGPGTLVTVSS

SEQ ID NO: 923 - protein, 29 aa, Oryctolagus cuniculus
QSVEESGGRLVTPGTPLTLTCTVSGFSLN

SEQ ID NO: 924 - protein, 5 aa, Oryctolagus cuniculus
NYAMS

SEQ ID NO: 925 - protein, 14 aa, Oryctolagus cuniculus
WVRQAPGKGLEWIG

SEQ ID NO: 926 - protein, 16 aa, Oryctolagus cuniculus
IMGVNDITYYASWAKG

SEQ ID NO: 927 - protein, 30 aa, Oryctolagus cuniculus
RFTISKTSTTVDLKMTSLTTEDTATYFCTR

SEQ ID NO: 928 - protein, 12 aa, Oryctolagus cuniculus
EIRDDGDSSDKL

SEQ ID NO: 929 - protein, 11 aa, Artificial
  Humanized antibody sequence
WGPGTLVTVSS

SEQ ID NO: 930 - protein, 330 aa, Artificial; identical to SEQ ID NO: 10
  Humanized antibody sequence

SEQ ID NO: 931 - DNA, 1341 bp, Artificial
  Humanized antibody sequence
cagtcggtggaggagtccgggggtcgcctggtcacgcctgggacacccctgacactcacctgcaccgtctctggattctccctcaataactatgcaatgagctgggtccgccaggctccagggaaggggctggaatggatcggaatcatgggtgttaatgatatcacatactacgcgagctgggcgaaaggccgattcaccatctccaaaacctcgaccacggtggatctgaaaatgaccagtctgacaaccgaggacacggccacctatttctgtactagagagatccgtgatgatggtgatagttctgataagttgtggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 932 - DNA, 351 bp, Artificial
  Humanized antibody sequence
cagtcggtggaggagtccgggggtcgcctggtcacgcctgggacacccctgacactcacctgcaccgtctctggattctccctcaataactatgcaatgagctgggtccgccaggctccagggaaggggctggaatggatcggaatcatgggtgttaatgatatcacatactacgcgagctgggcgaaaggccgattcaccatctccaaaacctcgaccacggtggatctgaaaatgaccagtctgacaaccgaggacacggccacctatttctgtactagagagatccgtgatgatggtgatagttctgataagttgtggggcccgggcaccctcgtcaccgtctcgagc

SEQ ID NO: 933 - DNA, 87 bp, Oryctolagus cuniculus
cagtcggtggaggagtccgggggtcgcctggtcacgcctgggacacccctgacactcacctgcaccgtctctggattctccctcaat

SEQ ID NO: 934 - DNA, 15 bp, Oryctolagus cuniculus
aactatgcaatgagc

SEQ ID NO: 935 - DNA, 42 bp, Oryctolagus cuniculus; identical to SEQ ID NO: 15

SEQ ID NO: 936 - DNA, 48 bp, Oryctolagus cuniculus
atcatgggtgttaatgatatcacatactacgcgagctgggcgaaaggc

SEQ ID NO: 937 - DNA, 90 bp, Oryctolagus cuniculus
cgattcaccatctccaaaacctcgaccacggtggatctgaaaatgaccagtctgacaaccgaggacacggccacctatttctgtactaga

SEQ ID NO: 938 - DNA, 36 bp, Oryctolagus cuniculus
gagatccgtgatgatggtgatagttctgataagttg

SEQ ID NO: 939 - DNA, 33 bp, Artificial; identical to SEQ ID NO: 139
  Humanized antibody sequence

SEQ ID NO: 940 - DNA, 990 bp, Artificial; identical to SEQ ID NO: 20
  Humanized antibody sequence

SEQ ID NO: 941 - protein, 219 aa, Artificial
  Humanized antibody sequence
AIKMTQTPSSVSAAVGGTVTINCQASEDIYTNLAWYQQKPGQPPNLLIYDASDLASGVPSRFSGSGDGTQFTLTISAVQCEDAATYYCQGVAWSSNTGYGSAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 942 - protein, 113 aa, Artificial
  Humanized antibody sequence
AIKMTQTPSSVSAAVGGTVTINCQASEDIYTNLAWYQQKPGQPPNLLIYDASDLASGVPSRFSGSGDGTQFTLTISAVQCEDAATYYCQGVAWSSNTGYGSAFGGGTEVVVKR

SEQ ID NO: 943 - protein, 23 aa, Oryctolagus cuniculus
AIKMTQTPSSVSAAVGGTVTINC

SEQ ID NO: 944 - protein, 11 aa, Oryctolagus cuniculus
QASEDIYTNLA

SEQ ID NO: 945 - protein, 15 aa, Oryctolagus cuniculus
WYQQKPGQPPNLLIY

SEQ ID NO: 946 - protein, 7 aa, Oryctolagus cuniculus
DASDLAS

SEQ ID NO: 947 - protein, 32 aa, Oryctolagus cuniculus
GVPSRFSGSGDGTQFTLTISAVQCEDAATYYC

SEQ ID NO: 948 - protein, 14 aa, Oryctolagus cuniculus
QGVAWSSNTGYGSA

SEQ ID NO: 949 - protein, 11 aa, Artificial
  Humanized antibody sequence
FGGGTEVVVKR

SEQ ID NO: 950 - protein, 106 aa, Artificial; identical to SEQ ID NO: 30
  Humanized antibody sequence

SEQ ID NO: 951 - DNA, 657 bp, Artificial
  Humanized antibody sequence
gccatcaaaatgacccagactccatcctccgtgtctgcagctgtgggaggcacagtcaccatcaattgccaggccagtgaggacatttacaccaatttagcctggtatcagcagaaaccagggcagcctcccaacctcctgatctatgatgcatccgatctggcatctggggtcccgtcgcggttcagcggcagtggagatgggacacagttcactctcaccatcagcgccgtgcagtgtgaagatgctgccacttactactgtcaaggtgttgcttggagtagtaatactggttatggttccgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 952 - DNA, 339 bp, Artificial
  Humanized antibody sequence
gccatcaaaatgacccagactccatcctccgtgtctgcagctgtgggaggcacagtcaccatcaattgccaggccagtgaggacatttacaccaatttagcctggtatcagcagaaaccagggcagcctcccaacctcctgatctatgatgcatccgatctggcatctggggtcccgtcgcggttcagcggcagtggagatgggacacagttcactctcaccatcagcgccgtgcagtgtgaagatgctgccacttactactgtcaaggtgttgcttggagtagtaatactggttatggttccgctttcggcggagggaccgaggtggtggtcaaacgt

SEQ ID NO: 953 - DNA, 69 bp, Oryctolagus cuniculus
gccatcaaaatgacccagactccatcctccgtgtctgcagctgtgggaggcacagtcaccatcaattgc

SEQ ID NO: 954 - DNA, 33 bp, Oryctolagus cuniculus
caggccagtgaggacatttacaccaatttagcc

SEQ ID NO: 955 - DNA, 45 bp, Oryctolagus cuniculus
tggtatcagcagaaaccagggcagcctcccaacctcctgatctat

SEQ ID NO: 956 - DNA, 21 bp, Oryctolagus cuniculus
gatgcatccgatctggcatct

SEQ ID NO: 957 - DNA, 96 bp, Oryctolagus cuniculus
ggggtcccgtcgcggttcagcggcagtggagatgggacacagttcactctcaccatcagcgccgtgcagtgtgaagatgctgccacttactactgt

SEQ ID NO: 958 - DNA, 42 bp, Oryctolagus cuniculus
caaggtgttgcttggagtagtaatactggttatggttccgct

SEQ ID NO: 959 - DNA, 33 bp, Artificial; identical to SEQ ID NO: 39
  Humanized antibody sequence

SEQ ID NO: 960 - DNA, 318 bp, Artificial; identical to SEQ ID NO: 40
  Humanized antibody sequence

SEQ ID NO: 961-1000 - skipped (40 entries)

SEQ ID NO: 1001 - protein, 448 aa, Artificial
  Humanized antibody sequence
EVQLVESGGGLVQPGGSLRLSCAASGFSLSSYAMIWVRQAPGKGLEWVGIIYDNGDTYYASSAKGRFTISRDNSKNTVYLQMNSLRAEDTAVYFCAREPGSTTQNDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1002 - protein, 118 aa, Artificial
  Humanized antibody sequence
EVQLVESGGGLVQPGGSLRLSCAASGFSLSSYAMIWVRQAPGKGLEWVGIIYDNGDTYYASSAKGRFTISRDNSKNTVYLQMNSLRAEDTAVYFCAREPGSTTQNDLWGQGTLVTVSS

SEQ ID NO: 1003 - protein, 30 aa, Artificial
  Humanized antibody sequence
EVQLVESGGGLVQPGGSLRLSCAASGFSLS

SEQ ID NO: 1004 - protein, 5 aa, Oryctolagus cuniculus
SYAMI

SEQ ID NO: 1005 - protein, 14 aa, Artificial
  Humanized antibody sequence
WVRQAPGKGLEWVG

SEQ ID NO: 1006 - protein, 16 aa, Artificial
  Humanized antibody sequence
IIYDNGDTYYASSAKG

SEQ ID NO: 1007 - protein, 32 aa, Artificial
  Humanized antibody sequence
RFTISRDNSKNTVYLQMNSLRAEDTAVYFCAR

SEQ ID NO: 1008 - protein, 10 aa, Oryctolagus cuniculus
EPGSTTQNDL

SEQ ID NO: 1009 - protein, 11 aa, Artificial
  Humanized antibody sequence
WGQGTLVTVSS

SEQ ID NO: 1010 - protein, 330 aa, Artificial; identical to SEQ ID NO: 50
  Humanized antibody sequence

SEQ ID NO: 1011 - DNA, 1344 bp, Artificial
  Humanized antibody sequence
gaggtgcagcttgtggagtctgggggaggcttggtccagcctggggggtccctgagactctcctgtgcagcctctggattctccctcagtagctatgcgatgatctgggtccgtcaggctccagggaaggggctggagtgggtcggaatcatttatgataatggtgacacatactacgcgagctctgcgaaaggccgattcaccatctccagagacaattccaagaacaccgtgtatcttcaaatgaacagcctgagagctgaggacactgctgtgtatttctgtgctagagagcctggtagtactactcagaatgacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1012 - DNA, 354 bp, Artificial
  Humanized antibody sequence
gaggtgcagcttgtggagtctgggggaggcttggtccagcctggggggtccctgagactctcctgtgcagcctctggattctccctcagtagctatgcgatgatctgggtccgtcaggctccagggaaggggctggagtgggtcggaatcatttatgataatggtgacacatactacgcgagctctgcgaaaggccgattcaccatctccagagacaattccaagaacaccgtgtatcttcaaatgaacagcctgagagctgaggacactgctgtgtatttctgtgctagagagcctggtagtactactcagaatgacttgtggggccaagggaccctcgtcaccgtctcgagc

SEQ ID NO: 1013 - DNA, 90 bp, Artificial
  Humanized antibody sequence
gaggtgcagcttgtggagtctgggggaggcttggtccagcctggggggtccctgagactctcctgtgcagcctctggattctccctcagt

SEQ ID NO: 1014 - DNA, 15 bp, Oryctolagus cuniculus
agctatgcgatgatc

SEQ ID NO: 1015 - DNA, 42 bp, Artificial
  Humanized antibody sequence
tgggtccgtcaggctccagggaaggggctggagtgggtcgga

SEQ ID NO: 1016 - DNA, 48 bp, Artificial
  Humanized antibody sequence
atcatttatgataatggtgacacatactacgcgagctctgcgaaaggc

SEQ ID NO: 1017 - DNA, 96 bp, Artificial
  Humanized antibody sequence
cgattcaccatctccagagacaattccaagaacaccgtgtatcttcaaatgaacagcctgagagctgaggacactgctgtgtatttctgtgctaga

SEQ ID NO: 1018 - DNA, 30 bp, Oryctolagus cuniculus; identical to SEQ ID NO: 498

SEQ ID NO: 1019 - DNA, 33 bp, Artificial; identical to SEQ ID NO: 59
  Humanized antibody sequence

SEQ ID NO: 1020 - DNA, 990 bp, Artificial; identical to SEQ ID NO: 60
  Humanized antibody sequence

SEQ ID NO: 1021 - protein, 217 aa, Artificial
  Humanized antibody sequence
DVQMTQSPSTLSASVGDRVTITCQASENIYNSLLWYQQKPGKAPKLLIYRASTLASGVPSRFSGSGSGTEFTLTISSLQPDDFATYYCQNYYNIWTNGAAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1022 - protein, 111 aa, Artificial
  Humanized antibody sequence
DVQMTQSPSTLSASVGDRVTITCQASENIYNSLLWYQQKPGKAPKLLIYRASTLASGVPSRFSGSGSGTEFTLTISSLQPDDFATYYCQNYYNIWTNGAAFGGGTKVEIKR

SEQ ID NO: 1023 - protein, 23 aa, Artificial
  Humanized antibody sequence
DVQMTQSPSTLSASVGDRVTITC

SEQ ID NO: 1024 - protein, 11 aa, Oryctolagus cuniculus
QASENIYNSLL

SEQ ID NO: 1025 - protein, 15 aa, Artificial
  Humanized antibody sequence
WYQQKPGKAPKLLIY

SEQ ID NO: 1026 - protein, 7 aa, Oryctolagus cuniculus
RASTLAS

SEQ ID NO: 1027 - protein, 32 aa, Artificial; identical to SEQ ID NO: 67
  Humanized antibody sequence

SEQ ID NO: 1028 - protein, 12 aa, Oryctolagus cuniculus
QNYYNIWTNGAA

SEQ ID NO: 1029 - protein, 11 aa, Artificial
  Humanized antibody sequence
FGGGTKVEIKR

SEQ ID NO: 1030 - protein, 106 aa, Artificial; identical to SEQ ID NO: 30
  Humanized antibody sequence

SEQ ID NO: 1031 - DNA, 651 bp, Artificial
  Humanized antibody sequence
gacgttcagatgacccagtctccttccaccctgtctgcatctgtaggagacagagtcaccatcacttgtcaggccagtgagaacatttacaactctttactctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttactactgtcaaaactattataatatatggactaatggtgctgctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1032 - DNA, 333 bp, Artificial
  Humanized antibody sequence
gacgttcagatgacccagtctccttccaccctgtctgcatctgtaggagacagagtcaccatcacttgtcaggccagtgagaacatttacaactctttactctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttactactgtcaaaactattataatatatggactaatggtgctgctttcggcggaggaaccaaggtggaaatcaaacgt

SEQ ID NO: 1033 - DNA, 69 bp, Artificial
  Humanized antibody sequence
gacgttcagatgacccagtctccttccaccctgtctgcatctgtaggagacagagtcaccatcacttgt

SEQ ID NO: 1034 - DNA, 33 bp, Oryctolagus cuniculus; identical to SEQ ID NO: 514

SEQ ID NO: 1035 - DNA, 45 bp, Artificial
  Humanized antibody sequence
tggtatcagcagaaaccaggaaaagcccctaagctcctgatctat

SEQ ID NO: 1036 - DNA, 21 bp, Oryctolagus cuniculus
agggcatccactctggcatct

SEQ ID NO: 1037 - DNA, 96 bp, Artificial; identical to SEQ ID NO: 77
  Humanized antibody sequence

SEQ ID NO: 1038 - DNA, 36 bp, Oryctolagus cuniculus; identical to SEQ ID NO: 518

SEQ ID NO: 1039 - DNA, 33 bp, Artificial; identical to SEQ ID NO: 79
  Humanized antibody sequence

SEQ ID NO: 1040 - DNA, 318 bp, Artificial; identical to SEQ ID NO: 40
  Humanized antibody sequence

SEQ ID NO: 1041 - protein, 444 aa, Artificial
  Humanized antibody sequence
EVQLVESGGGLVQPGGSLRLSCAASGFSLSSYAMGWVRQAPGKGLEWIGDISTYGTTDYASWVYGRFTISRDNSKNTVYLQMNSLRAEDTAVYFCARDYWLSLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1042 - protein, 114 aa, Artificial
  Humanized antibody sequence
EVQLVESGGGLVQPGGSLRLSCAASGFSLSSYAMGWVRQAPGKGLEWIGDISTYGTTDYASWVYGRFTISRDNSKNTVYLQMNSLRAEDTAVYFCARDYWLSLWGQGTLVTVSS

SEQ ID NO: 1043 - protein, 30 aa, Artificial; identical to SEQ ID NO: 1003
  Humanized antibody sequence

SEQ ID NO: 1044 - protein, 5 aa, Oryctolagus cuniculus
SYAMG

SEQ ID NO: 1045 - protein, 14 aa, Artificial
  Humanized antibody sequence
WVRQAPGKGLEWIG

SEQ ID NO: 1046 - protein, 16 aa, Oryctolagus cuniculus
DISTYGTTDYASWVYG

SEQ ID NO: 1047 - protein, 32 aa, Artificial; identical to SEQ ID NO: 1007
  Humanized antibody sequence

SEQ ID NO: 1048 - protein, 6 aa, Oryctolagus cuniculus
DYWLSL

SEQ ID NO: 1049 - protein, 11 aa, Artificial
  Humanized antibody sequence
WGQGTLVTVSS

SEQ ID NO: 1050 - protein, 330 aa, Artificial; identical to SEQ ID NO: 50
  Humanized antibody sequence

SEQ ID NO: 1051 - DNA, 1332 bp, Artificial
  Humanized antibody sequence
gaggtgcagcttgtggagtctgggggaggcttggtccagcctggggggtccctgagactctcctgtgcagcctctggattctccctcagtagctatgcaatgggctgggtccgtcaggctccagggaaggggctggagtggatcggagacattagtacttatggtaccacagactacgcgagctgggtgtatggccgattcaccatctccagagacaattccaagaacaccgtgtatcttcaaatgaacagcctgagagctgaggacactgctgtgtatttctgtgctagagactattggttgagcttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1052 - DNA, 342 bp, Artificial
  Humanized antibody sequence
gaggtgcagcttgtggagtctgggggaggcttggtccagcctggggggtccctgagactctcctgtgcagcctctggattctccctcagtagctatgcaatgggctgggtccgtcaggctccagggaaggggctggagtggatcggagacattagtacttatggtaccacagactacgcgagctgggtgtatggccgattcaccatctccagagacaattccaagaacaccgtgtatcttcaaatgaacagcctgagagctgaggacactgctgtgtatttctgtgctagagactattggttgagcttgtggggccaagggaccctcgtcaccgtctcgagc

SEQ ID NO: 1053 - DNA, 90 bp, Artificial; identical to SEQ ID NO: 1013
  Humanized antibody sequence

SEQ ID NO: 1054 - DNA, 15 bp, Oryctolagus cuniculus
agctatgcaatgggc

SEQ ID NO: 1055 - DNA, 42 bp, Artificial; identical to SEQ ID NO: 55
  Humanized antibody sequence

SEQ ID NO: 1056 - DNA, 48 bp, Oryctolagus cuniculus; identical to SEQ ID NO: 616

SEQ ID NO: 1057 - DNA, 96 bp, Artificial; identical to SEQ ID NO: 1017
  Humanized antibody sequence

SEQ ID NO: 1058 - DNA, 18 bp, Oryctolagus cuniculus
gactattggttgagcttg

SEQ ID NO: 1059 - DNA, 33 bp, Artificial; identical to SEQ ID NO: 59
  Humanized antibody sequence

SEQ ID NO: 1060 - DNA, 990 bp, Artificial; identical to SEQ ID NO: 60
  Humanized antibody sequence

SEQ ID NO: 1061 - protein, 218 aa, Artificial
  Humanized antibody sequence
AAQLTQSPSTLSASVGDRVTITCQSSQSVYDNNALAWYQQKPGKAPKLLIYAASTLASGVPSRFSGSGSGTEFTLTISSLQPDDFATYYCLGGYYDPADNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1062 - protein, 112 aa, Artificial
  Humanized antibody sequence
AAQLTQSPSTLSASVGDRVTITCQSSQSVYDNNALAWYQQKPGKAPKLLIYAASTLASGVPSRFSGSGSGTEFTLTISSLQPDDFATYYCLGGYYDPADNAFGGGTKVEIKR

SEQ ID NO: 1063 - protein, 23 aa, Artificial
  Humanized antibody sequence
AAQLTQSPSTLSASVGDRVTITC

SEQ ID NO: 1064 - protein, 13 aa, Oryctolagus cuniculus
QSSQSVYDNNALA

SEQ ID NO: 1065 - protein, 15 aa, Artificial
  Humanized antibody sequence
WYQQKPGKAPKLLIY

SEQ ID NO: 1066 - protein, 7 aa, Oryctolagus cuniculus
AASTLAS

SEQ ID NO: 1067 - protein, 32 aa, Artificial; identical to SEQ ID NO: 67
  Humanized antibody sequence

SEQ ID NO: 1068 - protein, 11 aa, Oryctolagus cuniculus
LGGYYDPADNA

SEQ ID NO: 1069 - protein, 11 aa, Artificial
  Humanized antibody sequence
FGGGTKVEIKR

SEQ ID NO: 1070 - protein, 106 aa, Artificial; identical to SEQ ID NO: 30
  Humanized antibody sequence

SEQ ID NO: 1071 - DNA, 654 bp, Artificial
  Humanized antibody sequence
gcagcccagctgacccagtctccttccaccctgtctgcatctgtaggagacagagtcaccatcacttgtcagtccagtcagagtgtttatgataacaatgctttagcctggtatcagcagaaaccaggaaaagcccctaagctcctgatctatgctgcatccactctggcatctggagtcccatcaaggttcagcggcagtggatctggaacagaattcactctcaccatcagcagcctgcagcctgatgattttgcaacttactactgtctaggcggttattatgatcctgctgataatgctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1072 - DNA, 336 bp, Artificial
  Humanized antibody sequence
gcagcccagctgacccagtctccttccaccctgtctgcatctgtaggagacagagtcaccatcacttgtcagtccagtcagagtgtttatgataacaatgctttagcctggtatcagcagaaaccaggaaaagcccctaagctcctgatctatgctgcatccactctggcatctggagtcccatcaaggttcagcggcagtggatctggaacagaattcactctcaccatcagcagcctgcagcctgatgattttgcaacttactactgtctaggcggttattatgatcctgctgataatgctttcggcggaggaaccaaggtggaaatcaaacgt

SEQ ID NO: 1073 - DNA, 69 bp, Artificial
  Humanized antibody sequence
gcagcccagctgacccagtctccttccaccctgtctgcatctgtaggagacagagtcaccatcacttgt

SEQ ID NO: 1074 - DNA, 39 bp, Oryctolagus cuniculus; identical to SEQ ID NO: 554

SEQ ID NO: 1075 - DNA, 45 bp, Artificial; identical to SEQ ID NO: 1035
  Humanized antibody sequence

SEQ ID NO: 1076 - DNA, 21 bp, Oryctolagus cuniculus
gctgcatccactctggcatct

SEQ ID NO: 1077 - DNA, 96 bp, Artificial; identical to SEQ ID NO: 77
  Humanized antibody sequence

SEQ ID NO: 1078 - DNA, 33 bp, Oryctolagus cuniculus; identical to SEQ ID NO: 638

SEQ ID NO: 1079 - DNA, 33 bp, Artificial; identical to SEQ ID NO: 79
  Humanized antibody sequence

SEQ ID NO: 1080 - DNA, 318 bp, Artificial; identical to SEQ ID NO: 40
  Humanized antibody sequence

SEQ ID NO: 1081 - protein, 453 aa, Artificial
  Humanized antibody sequence
EVQLVESGGGLVQPGGSLRLSCAASGFSLSSYDMSWVRQAPGKGLEWIGIINTNDDTWYASWVKGRFTISRDNSKNTLYLQMNSLRAEDTAVYYCARISDAYVFDYAYYFTLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1082 - protein, 123 aa, Artificial
  Humanized antibody sequence
EVQLVESGGGLVQPGGSLRLSCAASGFSLSSYDMSWVRQAPGKGLEWIGIINTNDDTWYASWVKGRFTISRDNSKNTLYLQMNSLRAEDTAVYYCARISDAYVFDYAYYFTLWGQGTLVTVSS

SEQ ID NO: 1083 - protein, 30 aa, Artificial; identical to SEQ ID NO: 1003
  Humanized antibody sequence

SEQ ID NO: 1084 - protein, 5 aa, Oryctolagus cuniculus
SYDMS

SEQ ID NO: 1085 - protein, 14 aa, Artificial
  Humanized antibody sequence
WVRQAPGKGLEWIG

SEQ ID NO: 1086 - protein, 16 aa, Oryctolagus cuniculus
IINTNDDTWYASWVKG

SEQ ID NO: 1087 - protein, 32 aa, Artificial; identical to SEQ ID NO: 47
  Humanized antibody sequence

SEQ ID NO: 1088 - protein, 15 aa, Oryctolagus cuniculus
ISDAYVFDYAYYFTL

SEQ ID NO: 1089 - protein, 11 aa, Artificial
  Humanized antibody sequence
WGQGTLVTVSS

SEQ ID NO: 1090 - protein, 330 aa, Artificial; identical to SEQ ID NO: 50
  Humanized antibody sequence

SEQ ID NO: 1091 - DNA, 1359 bp, Artificial
  Humanized antibody sequence
gaggtgcagcttgtggagtctgggggaggcttggtccagcctggggggtccctgagactctcctgtgcagcctctggattctccctcagtagctacgacatgagctgggtccgtcaggctccagggaaggggctggagtggatcggaatcattaatactaatgatgacacatggtacgcgagctgggtgaaaggccgattcaccatctccagagacaattccaagaacaccctgtatcttcaaatgaacagcctgagagctgaggacactgctgtgtattactgtgctagaatatccgatgcttatgtttttgattatgcgtattactttactttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1092 - DNA, 369 bp, Artificial
  Humanized antibody sequence
gaggtgcagcttgtggagtctgggggaggcttggtccagcctggggggtccctgagactctcctgtgcagcctctggattctccctcagtagctacgacatgagctgggtccgtcaggctccagggaaggggctggagtggatcggaatcattaatactaatgatgacacatggtacgcgagctgggtgaaaggccgattcaccatctccagagacaattccaagaacaccctgtatcttcaaatgaacagcctgagagctgaggacactgctgtgtattactgtgctagaatatccgatgcttatgtttttgattatgcgtattactttactttgtggggccaagggaccctcgtcaccgtctcgagc

SEQ ID NO: 1093 - DNA, 90 bp, Artificial; identical to SEQ ID NO: 1013
  Humanized antibody sequence

SEQ ID NO: 1094 - DNA, 15 bp, Oryctolagus cuniculus
agctacgacatgagc

SEQ ID NO: 1095 - DNA, 42 bp, Artificial; identical to SEQ ID NO: 55
  Humanized antibody sequence

SEQ ID NO: 1096 - DNA, 48 bp, Oryctolagus cuniculus; identical to SEQ ID NO: 656

SEQ ID NO: 1097 - DNA, 96 bp, Artificial; identical to SEQ ID NO: 57
  Humanized antibody sequence

SEQ ID NO: 1098 - DNA, 45 bp, Oryctolagus cuniculus; identical to SEQ ID NO: 658

SEQ ID NO: 1099 - DNA, 33 bp, Artificial; identical to SEQ ID NO: 59
  Humanized antibody sequence

SEQ ID NO: 1100 - DNA, 990 bp, Artificial; identical to SEQ ID NO: 60
  Humanized antibody sequence

SEQ ID NO: 1101 - protein, 217 aa, Artificial
  Humanized antibody sequence
DIQMTQSPSTLSASVGDRVTITCLASQNIYNSLAWYQQKPGKAPKLLIYRASTLASGVPSRFSGSGSGTEFTLTISSLQPDDFATYYCQQGAGADNIGNPFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1102 - protein, 111 aa, Artificial
  Humanized antibody sequence
DIQMTQSPSTLSASVGDRVTITCLASQNIYNSLAWYQQKPGKAPKLLIYRASTLASGVPSRFSGSGSGTEFTLTISSLQPDDFATYYCQQGAGADNIGNPFGGGTKVEIKR

SEQ ID NO: 1103 - protein, 23 aa, Artificial
  Humanized antibody sequence
DIQMTQSPSTLSASVGDRVTITC

SEQ ID NO: 1104 - protein, 11 aa, Oryctolagus cuniculus
LASQNIYNSLA

SEQ ID NO: 1105 - protein, 15 aa, Artificial
  Humanized antibody sequence
WYQQKPGKAPKLLIY

SEQ ID NO: 1106 - protein, 7 aa, Oryctolagus cuniculus
RASTLAS

SEQ ID NO: 1107 - protein, 32 aa, Artificial; identical to SEQ ID NO: 67
  Humanized antibody sequence

SEQ ID NO: 1108 - protein, 12 aa, Oryctolagus cuniculus
QQGAGADNIGNP

SEQ ID NO: 1109 - protein, 11 aa, Artificial
  Humanized antibody sequence
FGGGTKVEIKR

SEQ ID NO: 1110 - protein, 106 aa, Artificial; identical to SEQ ID NO: 30
  Humanized antibody sequence

SEQ ID NO: 1111 - DNA, 651 bp, Artificial
  Humanized antibody sequence
gacatccagatgacccagtctccttccaccctgtctgcatctgtaggagacagagtcaccatcacttgtctggccagtcagaacatttacaattctttagcctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttactactgtcaacagggtgctggtgctgataatattggtaatcctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1112 - DNA, 333 bp, Artificial
  Humanized antibody sequence
gacatccagatgacccagtctccttccaccctgtctgcatctgtaggagacagagtcaccatcacttgtctggccagtcagaacatttacaattctttagcctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttactactgtcaacagggtgctggtgctgataatattggtaatcctttcggcggaggaaccaaggtggaaatcaaacgt

SEQ ID NO: 1113 - DNA, 69 bp, Artificial; identical to SEQ ID NO: 73
  Humanized antibody sequence

SEQ ID NO: 1114 - DNA, 33 bp, Oryctolagus cuniculus; identical to SEQ ID NO: 674

SEQ ID NO: 1115 - DNA, 45 bp, Artificial; identical to SEQ ID NO: 1035
  Humanized antibody sequence

SEQ ID NO: 1116 - DNA, 21 bp, Oryctolagus cuniculus
agggcatccactctggcatct

SEQ ID NO: 1117 - DNA, 96 bp, Artificial; identical to SEQ ID NO: 77
  Humanized antibody sequence

SEQ ID NO: 1118 - DNA, 36 bp, Oryctolagus cuniculus; identical to SEQ ID NO: 678

SEQ ID NO: 1119 - DNA, 33 bp, Artificial; identical to SEQ ID NO: 79
  Humanized antibody sequence

SEQ ID NO: 1120 - DNA, 318 bp, Artificial; identical to SEQ ID NO: 40
  Humanized antibody sequence

SEQ ID NO: 1121 - protein, 452 aa, Artificial
  Humanized antibody sequence
EVQLVESGGGLVQPGGSLRLSCAASGFSFSSSDYMCWVRQAPGKGLEWIGCIDAGSSGDTYFASSAKGRFTISRDNSKNTVYLQMNSLRAEDTAVYFCARHLYGSITFAFGLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1122 - protein, 123 aa, Artificial
  Humanized antibody sequence
EVQLVESGGGLVQPGGSLRLSCAASGFSFSSSDYMCWVRQAPGKGLEWIGCIDAGSSGDTYFASSAKGRFTISRDNSKNTVYLQMNSLRAEDTAVYFCARHLYGSITFAFGLWGQGTLVTVSS

SEQ ID NO: 1123 - protein, 30 aa, Artificial
  Humanized antibody sequence
EVQLVESGGGLVQPGGSLRLSCAASGFSFS

SEQ ID NO: 1124 - protein, 6 aa, Oryctolagus cuniculus
SSDYMC

SEQ ID NO: 1125 - protein, 14 aa, Artificial
  Humanized antibody sequence
WVRQAPGKGLEWIG

SEQ ID NO: 1126 - protein, 18 aa, Artificial
  Humanized antibody sequence
CIDAGSSGDTYFASSAKG

SEQ ID NO: 1127 - protein, 32 aa, Artificial; identical to SEQ ID NO: 1007
  Humanized antibody sequence

SEQ ID NO: 1128 - protein, 12 aa, Oryctolagus cuniculus
HLYGSITFAFGL

SEQ ID NO: 1129 - protein, 11 aa, Artificial
  Humanized antibody sequence
WGQGTLVTVSS

SEQ ID NO: 1130 - protein, 329 aa, Artificial
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1131 - DNA, 1356 bp, Artificial
  Humanized antibody sequence
gaggtgcagcttgtggagtctgggggaggcttggtccagcctggggggtccctgagactctcctgtgcagcctctggattctccttcagtagcagcgactacatgtgctgggtccgtcaggctccagggaaggggctggagtggatcggatgcattgatgctggtagtagtggtgacacttacttcgcgagctctgcgaaaggccgattcaccatctccagagacaattccaagaacaccgtgtatcttcaaatgaacagcctgagagctgaggacactgctgtgtatttctgtgctagacatctttatggtagtattactttcgcctttggcttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggt

SEQ ID NO: 1132 - DNA, 369 bp, Artificial
  Humanized antibody sequence
gaggtgcagcttgtggagtctgggggaggcttggtccagcctggggggtccctgagactctcctgtgcagcctctggattctccttcagtagcagcgactacatgtgctgggtccgtcaggctccagggaaggggctggagtggatcggatgcattgatgctggtagtagtggtgacacttacttcgcgagctctgcgaaaggccgattcaccatctccagagacaattccaagaacaccgtgtatcttcaaatgaacagcctgagagctgaggacactgctgtgtatttctgtgctagacatctttatggtagtattactttcgcctttggcttgtggggccaagggaccctcgtcaccgtctcgagc

SEQ ID NO: 1133 - DNA, 90 bp, Artificial
  Humanized antibody sequence
gaggtgcagcttgtggagtctgggggaggcttggtccagcctggggggtccctgagactctcctgtgcagcctctggattctccttcagt

SEQ ID NO: 1134 - DNA, 18 bp, Oryctolagus cuniculus
agcagcgactacatgtgc

SEQ ID NO: 1135 - DNA, 42 bp, Artificial; identical to SEQ ID NO: 55
  Humanized antibody sequence

SEQ ID NO: 1136 - DNA, 54 bp, Artificial
  Humanized antibody sequence
tgcattgatgctggtagtagtggtgacacttacttcgcgagctctgcgaaaggc

SEQ ID NO: 1137 - DNA, 96 bp, Artificial; identical to SEQ ID NO: 1017
  Humanized antibody sequence

SEQ ID NO: 1138 - DNA, 36 bp, Oryctolagus cuniculus; identical to SEQ ID NO: 698

SEQ ID NO: 1139 - DNA, 33 bp, Artificial; identical to SEQ ID NO: 59
  Humanized antibody sequence

SEQ ID NO: 1140 - DNA, 987 bp, Artificial
  Humanized antibody sequence
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggt

SEQ ID NO: 1141 - protein, 217 aa, Artificial
  Humanized antibody sequence
AAQMTQSPSTLSASVGDRVTITCQASQSIGSDLAWYQQKPGKAPKLLIYDASTLASGVPSRFSGSGSGTEFTLTISSLQPDDFATYYCQGTYYSSGWYTAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1142 - protein, 111 aa, Artificial
  Humanized antibody sequence
AAQMTQSPSTLSASVGDRVTITCQASQSIGSDLAWYQQKPGKAPKLLIYDASTLASGVPSRFSGSGSGTEFTLTISSLQPDDFATYYCQGTYYSSGWYTAFGGGTKVEIKR

SEQ ID NO: 1143 - protein, 23 aa, Artificial
  Humanized antibody sequence
AAQMTQSPSTLSASVGDRVTITC

SEQ ID NO: 1144 - protein, 11 aa, Oryctolagus cuniculus
QASQSIGSDLA

SEQ ID NO: 1145 - protein, 15 aa, Artificial
  Humanized antibody sequence
WYQQKPGKAPKLLIY

SEQ ID NO: 1146 - protein, 7 aa, Oryctolagus cuniculus
DASTLAS

SEQ ID NO: 1147 - protein, 32 aa, Artificial; identical to SEQ ID NO: 67
  Humanized antibody sequence

SEQ ID NO: 1148 - protein, 12 aa, Oryctolagus cuniculus
QGTYYSSGWYTA

SEQ ID NO: 1149 - protein, 11 aa, Artificial
  Humanized antibody sequence
FGGGTKVEIKR

SEQ ID NO: 1150 - protein, 106 aa, Artificial; identical to SEQ ID NO: 30
  Humanized antibody sequence

SEQ ID NO: 1151 - DNA, 651 bp, Artificial
  Humanized antibody sequence
gcagcccagatgacccagtctccttccaccctgtctgcatctgtaggagacagagtcaccatcacttgtcaggccagtcagagcattggtagcgacttagcctggtatcagcagaaaccaggaaaagcccctaagctcctgatctatgatgcatccactctggcatctggagtcccatcaaggttcagcggcagtggatctggaacagaattcactctcaccatcagcagcctgcagcctgatgattttgcaacttactactgtcaaggcacttattatagtagtggttggtacactgctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1152 - DNA, 333 bp, Artificial
  Humanized antibody sequence
gcagcccagatgacccagtctccttccaccctgtctgcatctgtaggagacagagtcaccatcacttgtcaggccagtcagagcattggtagcgacttagcctggtatcagcagaaaccaggaaaagcccctaagctcctgatctatgatgcatccactctggcatctggagtcccatcaaggttcagcggcagtggatctggaacagaattcactctcaccatcagcagcctgcagcctgatgattttgcaacttactactgtcaaggcacttattatagtagtggttggtacactgctttcggcggaggaaccaaggtggaaatcaaacgt

SEQ ID NO: 1153 - DNA, 69 bp, Artificial
  Humanized antibody sequence
gcagcccagatgacccagtctccttccaccctgtctgcatctgtaggagacagagtcaccatcacttgt

SEQ ID NO: 1154 - DNA, 33 bp, Oryctolagus cuniculus; identical to SEQ ID NO: 714

SEQ ID NO: 1155 - DNA, 45 bp, Artificial; identical to SEQ ID NO: 1035
  Humanized antibody sequence

SEQ ID NO: 1156 - DNA, 21 bp, Oryctolagus cuniculus
gatgcatccactctggcatct

SEQ ID NO: 1157 - DNA, 96 bp, Artificial; identical to SEQ ID NO: 77
  Humanized antibody sequence

SEQ ID NO: 1158 - DNA, 36 bp, Oryctolagus cuniculus; identical to SEQ ID NO: 718

SEQ ID NO: 1159 - DNA, 33 bp, Artificial; identical to SEQ ID NO: 79
  Humanized antibody sequence

SEQ ID NO: 1160 - DNA, 318 bp, Artificial; identical to SEQ ID NO: 40
  Humanized antibody sequence

SEQ ID NO: 1161 - protein, 444 aa, Artificial
  Humanized antibody sequence
EVQLVESGGGLVQPGGSLRLSCAASGFTVSRDYWICWVRQAPGKGLEWIGCISAGGGSTDYANWVNGRFTISRDISKNTGYLQMNSLRAEDTAVYYCAGNLEIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1162 - protein, 114 aa, Artificial
  Humanized antibody sequence
EVQLVESGGGLVQPGGSLRLSCAASGFTVSRDYWICWVRQAPGKGLEWIGCISAGGGSTDYANWVNGRFTISRDISKNTGYLQMNSLRAEDTAVYYCAGNLEIWGQGTLVTVSS

SEQ ID NO: 1163 - protein, 30 aa, Artificial; identical to SEQ ID NO: 43
  Humanized antibody sequence

SEQ ID NO: 1164 - protein, 6 aa, Oryctolagus cuniculus
RDYWIC

SEQ ID NO: 1165 - protein, 14 aa, Artificial
  Humanized antibody sequence
WVRQAPGKGLEWIG

SEQ ID NO: 1166 - protein, 17 aa, Oryctolagus cuniculus
CISAGGGSTDYANWVNG

SEQ ID NO: 1167 - protein, 32 aa, Artificial
  Humanized antibody sequence
RFTISRDISKNTGYLQMNSLRAEDTAVYYCAG

SEQ ID NO: 1168 - protein, 4 aa, Oryctolagus cuniculus
NLEI

SEQ ID NO: 1169 - protein, 11 aa, Artificial
  Humanized antibody sequence
WGQGTLVTVSS

SEQ ID NO: 1170 - protein, 330 aa, Artificial; identical to SEQ ID NO: 50
  Humanized antibody sequence

SEQ ID NO: 1171 - DNA, 1332 bp, Artificial
  Humanized antibody sequence
gaggtgcagcttgtggagtctgggggaggcttggtccagcctggggggtccctgagactctcctgtgcagcctctggattcaccgtcagtagggactactggatatgttgggtccgtcaggctccagggaaggggctggagtggattggatgcattagtgctggtggtggtagcacagactacgcgaactgggtgaatggccgattcaccatctccagagacatctccaagaacaccggttatcttcaaatgaacagcctgagagctgaggacactgctgtgtattactgtgcgggaaatctagagatctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1172 - DNA, 342 bp, Artificial
  Humanized antibody sequence
gaggtgcagcttgtggagtctgggggaggcttggtccagcctggggggtccctgagactctcctgtgcagcctctggattcaccgtcagtagggactactggatatgttgggtccgtcaggctccagggaaggggctggagtggattggatgcattagtgctggtggtggtagcacagactacgcgaactgggtgaatggccgattcaccatctccagagacatctccaagaacaccggttatcttcaaatgaacagcctgagagctgaggacactgctgtgtattactgtgcgggaaatctagagatctggggccaagggaccctcgtcaccgtctcgagc

SEQ ID NO: 1173 - DNA, 90 bp, Artificial; identical to SEQ ID NO: 53
  Humanized antibody sequence

SEQ ID NO: 1174 - DNA, 18 bp, Oryctolagus cuniculus
agggactactggatatgt

SEQ ID NO: 1175 - DNA, 42 bp, Artificial
  Humanized antibody sequence
tgggtccgtcaggctccagggaaggggctggagtggattgga

SEQ ID NO: 1176 - DNA, 51 bp, Oryctolagus cuniculus; identical to SEQ ID NO: 816

SEQ ID NO: 1177 - DNA, 96 bp, Artificial
  Humanized antibody sequence
cgattcaccatctccagagacatctccaagaacaccggttatcttcaaatgaacagcctgagagctgaggacactgctgtgtattactgtgcggga

SEQ ID NO: 1178 - DNA, 12 bp, Oryctolagus cuniculus
aatctagagatc

SEQ ID NO: 1179 - DNA, 33 bp, Artificial; identical to SEQ ID NO: 59
  Humanized antibody sequence

SEQ ID NO: 1180 - DNA, 990 bp, Artificial; identical to SEQ ID NO: 60
  Humanized antibody sequence

SEQ ID NO: 1181 - protein, 220 aa, Artificial
  Humanized antibody sequence
DIQMTQSPSTLSASVGDRVTITCQSSPSIYSGAFLSWYQQKPGKAPKFLIYEASKLASGVPSRFSGSGSGTEFTLTISSLQPDDFATYYCLGFYDCSSVDCHAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1182 - protein, 114 aa, Artificial
  Humanized antibody sequence
DIQMTQSPSTLSASVGDRVTITCQSSPSIYSGAFLSWYQQKPGKAPKFLIYEASKLASGVPSRFSGSGSGTEFTLTISSLQPDDFATYYCLGFYDCSSVDCHAFGGGTKVEIKR

SEQ ID NO: 1183 - protein, 23 aa, Artificial
  Humanized antibody sequence
DIQMTQSPSTLSASVGDRVTITC

SEQ ID NO: 1184 - protein, 13 aa, Oryctolagus cuniculus
QSSPSIYSGAFLS

SEQ ID NO: 1185 - protein, 15 aa, Artificial
  Humanized antibody sequence
WYQQKPGKAPKFLIY

SEQ ID NO: 1186 - protein, 7 aa, Oryctolagus cuniculus
EASKLAS

SEQ ID NO: 1187 - protein, 32 aa, Artificial; identical to SEQ ID NO: 67
  Humanized antibody sequence

SEQ ID NO: 1188 - protein, 13 aa, Oryctolagus cuniculus
LGFYDCSSVDCHA

SEQ ID NO: 1189 - protein, 11 aa, Artificial
  Humanized antibody sequence
FGGGTKVEIKR

SEQ ID NO: 1190 - protein, 106 aa, Artificial; identical to SEQ ID NO: 30
  Humanized antibody sequence

SEQ ID NO: 1191 - DNA, 660 bp, Artificial
  Humanized antibody sequence
gacatccagatgacccagtctccttccaccctgtctgcatctgtaggagacagagtcaccatcacttgtcagtccagtccgagtatctatagtggcgccttcttatcctggtatcagcagaaaccaggaaaagcccctaagttcctgatctatgaagcctccaaactggcatctggagtcccatcaaggttcagcggcagtggatctggaacagaattcactctcaccatcagcagcctgcagcctgatgattttgcaacttactactgtctaggcttctatgattgtagcagtgttgattgccatgctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1192 - DNA, 342 bp, Artificial
  Humanized antibody sequence
gacatccagatgacccagtctccttccaccctgtctgcatctgtaggagacagagtcaccatcacttgtcagtccagtccgagtatctatagtggcgccttcttatcctggtatcagcagaaaccaggaaaagcccctaagttcctgatctatgaagcctccaaactggcatctggagtcccatcaaggttcagcggcagtggatctggaacagaattcactctcaccatcagcagcctgcagcctgatgattttgcaacttactactgtctaggcttctatgattgtagcagtgttgattgccatgctttcggcggaggaaccaaggtggaaatcaaacgt

SEQ ID NO: 1193 - DNA, 69 bp, Artificial; identical to SEQ ID NO: 73
  Humanized antibody sequence

SEQ ID NO: 1194 - DNA, 39 bp, Artificial
  Humanized antibody sequence
cagtccagtccgagtatctatagtggcgccttcttatcc

SEQ ID NO: 1195 - DNA, 45 bp, Artificial; identical to SEQ ID NO: 75
  Humanized antibody sequence

SEQ ID NO: 1196 - DNA, 21 bp, Oryctolagus cuniculus
gaagcctccaaactggcatct

SEQ ID NO: 1197 - DNA, 96 bp, Artificial; identical to SEQ ID NO: 77
  Humanized antibody sequence

SEQ ID NO: 1198 - DNA, 39 bp, Artificial
  Humanized antibody sequence
ctaggcttctatgattgtagcagtgttgattgccatgct

SEQ ID NO: 1199 - DNA, 33 bp, Artificial; identical to SEQ ID NO: 79
  Humanized antibody sequence

SEQ ID NO: 1200 - DNA, 318 bp, Artificial; identical to SEQ ID NO: 40
  Humanized antibody sequence

SEQ ID NO: 1201-1240 - skipped (40 entries)

SEQ ID NO: 1241 - protein, 38 aa, Homo sapiens
  MOD_RES (38)..(38): AMIDATION
HSDGIFTDSYSRYRKQMAVKKYLAAVLGKRYKQRVKNK

SEQ ID NO: 1242 - protein, 27 aa, Homo sapiens
  MOD_RES (27)..(27): AMIDATION
HSDGIFTDSYSRYRKQMAVKKYLAAVL

SEQ ID NO: 1243 - protein, 28 aa, Homo sapiens
  MOD_RES (28)..(28): AMIDATION
HSDAVFTDNYTRLRKQMAVKKYLNSILN

SEQ ID NO: 1244 - protein, 330 aa, Artificial
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1245 - protein, 330 aa, Artificial; identical to SEQ ID NO: 10
  Humanized antibody sequence

SEQ ID NO: 1246 - protein, 330 aa, Artificial; identical to SEQ ID NO: 50
  Humanized antibody sequence

What is claimed is:

1. An anti-pituitary adenylate cyclase-activating peptide (anti-PACAP) antibody or antigen-binding fragment thereof comprising: (a) a heavy chain variable region comprising an amino acid sequence with at least 90% sequence identity to the amino acid sequence of SEQ ID NO: 1042 and comprising the complementarity-determining region 1 (CDR1) sequence consisting of the amino acid sequence of SEQ ID NO: 1044; a complementarity-determining region 2 (CDR2) sequence consisting of the amino acid sequence of SEQ ID NO: 1046; and a complementarity-determining region 3 (CDR3) sequence consisting of the amino acid sequence of SEQ ID NO: 1048; and (b) a light chain variable region comprising an amino acid sequence with at least 90% sequence identity to the amino acid sequence of SEQ ID NO: 1062 and comprising the CDR1 sequence consisting of the amino acid sequence of SEQ ID NO: 1064; a CDR2 sequence consisting of the amino acid sequence of SEQ ID NO: 1066; and a CDR3 sequence consisting of the amino acid sequence of SEQ ID NO: 1068.

2. The anti-PACAP antibody or antigen-binding fragment thereof of claim 1, wherein said heavy chain variable region comprises an amino acid sequence having at least 95% identity to the amino acid sequence of SEQ ID NO: 1042 and comprising a CDR1 consisting of the amino acid sequence of SEQ ID NO: 1044; a CDR2 consisting of the amino acid sequence of SEQ ID NO: 1046; and a CDR3 consisting of the amino acid sequence of SEQ ID NO: 1048.

3. The anti-PACAP antibody or antigen-binding fragment thereof of claim 1, wherein said light chain variable region comprises an amino acid sequence having at least 95% identity to the amino acid sequence of SEQ ID NO: 1062 and comprising a CDR1 consisting of the amino acid sequence of SEQ ID NO: 1064; a CDR2 consisting of the amino acid sequence of SEQ ID NO: 1066; and a CDR3 consisting of the amino acid sequence of SEQ ID NO: 1068.

4. The anti-PACAP antibody or antigen-binding fragment thereof of claim 1, wherein said light chain variable region comprises the amino acid sequence of SEQ ID NO: 1042, and said light chain variable region comprises the amino acid sequence of SEQ ID NO: 1062.

5. The anti-PACAP antibody or antigen-binding fragment thereof of claim 1, wherein said heavy chain comprises an amino acid sequence having at least 95% identity to the amino acid sequence of SEQ ID NO: 1041 and comprising a CDR1 consisting of the amino acid sequence of SEQ ID NO: 1044; a CDR2 consisting of the amino acid sequence of SEQ ID NO: 1046; and a CDR3 consisting of the amino acid sequence of SEQ ID NO: 1048; and said light chain comprises an amino acid sequence having at least 95% identity to the amino acid sequence of SEQ ID NO: 1061 and comprising a CDR1 consisting of the amino acid sequence of SEQ ID NO: 1064; a CDR2 consisting of the amino acid sequence of SEQ ID NO: 1066; and a CDR3 consisting of the amino acid sequence of SEQ ID NO: 1068.

6. An anti-PACAP antibody or antigen-binding fragment thereof comprising the heavy chain amino acid sequence of SEQ ID NO: 1041 and the light chain amino acid sequence of SEQ ID NO: 1061.

7. The anti-PACAP antibody or antigen-binding fragment thereof of claim 1, which is an antigen binding fragment selected from the group consisting of scFvs, fragment antigen binding ("Fab") fragments, Fab' fragments, monovalent antigen binding fragments and F(ab')2 fragments.

8. The anti-PACAP antibody or antigen-binding fragment thereof of claim 1, wherein said antibody or antigen binding fragment lacks N-glycosylation and/or O-glycosylation.

9. The anti-PACAP antibody or antigen-binding fragment thereof of claim 1, wherein said antibody or antigen binding fragment comprises a human IgG1, IgG2, IgG3, or IgG4 constant domain.

10. The anti-PACAP antibody or antigen-binding fragment thereof of claim 1, wherein said antibody or antigen binding fragment comprises an Fc region that has been modified to increase or decrease at least one of effector function, half-life, proteolysis, or glycosylation.

11. The anti-PACAP antibody or antigen-binding fragment thereof of claim 10, wherein said Fc region comprises the sequence of any of the amino acid sequence of SEQ ID NO:1244, 1245 or 1246.

12. The anti-PACAP antibody or antigen-binding fragment thereof of claim 1, herein said antibody or antigen binding fragment binds to human pituitary adenylate cyclase-activating peptide (PACAP) with a binding affinity ($K_D$) of less than or equal to $5 \times 10^{-10}$ M as determined by surface plasmon resonance at 25° C.

13. The anti-PACAP antibody or antigen-binding fragment thereof of claim 1, wherein said antibody or antigen binding fragment binds to pituitary adenylate cyclase-activating peptide (PACAP) with an off-rate ($k_d$) of less than or equal to $5 \times 10^{-4}$ s$^{-1}$.

14. The anti-PACAP antibody or antigen-binding fragment thereof of claim 1, wherein said antibody or antigen binding fragment is directly or indirectly attached to a detectable label or therapeutic agent.

15. The anti-PACAP antibody or antigen-binding fragment thereof of claim 1, wherein said antibody or antigen binding fragment has stronger affinity for human pituitary adenylate cyclase-activating peptide (PACAP) than human vasoactive intestinal peptide (VIP).

16. The anti-PACAP antibody or antigen-binding fragment thereof of claim 1, wherein the binding affinity ($K_D$) of said antibody or antigen binding fragment to human pituitary adenylate cyclase-activating peptide (PACAP) is at least 10-fold stronger than the binding affinity of said antibody or antigen binding fragment to human vasoactive intestinal peptide (VIP).

17. A composition comprising at least one anti-PACAP antibody or antigen binding fragment according to claim 1 and a pharmaceutically acceptable diluent, carrier, solubilizer, emulsifier, preservative, or mixture thereof.

18. The composition according to claim 17, wherein said composition is suitable for subcutaneous, intravenous, or intramuscular administration.

19. The composition according to claim 17, wherein said composition is lyophilized, stabilized, and/or formulated for administration by injection.

* * * * *